United States Patent 12,577,609 (METHODS FOR CELL-TYPE SPECIFIC PROFILING TO IDENTIFY DRUG TARGETS) - sequence listing, part 9

SEQ ID NO: 10669 - DNA, 2577 bp, Homo sapiens
  ENST00000521134
acttgttaaaaatcttgttcttgcattcattaccttatgaagcctgcagaacacgccacgatgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaat

SEQ ID NO: 10670 - DNA, 2801 bp, Homo sapiens
  ENST00000519445
cagagcagcagcggagaaggcgaagcggccggcgggggcgaggcagatggggctcaaggcgcgcagggcggcgggggcggctggcggcggcggcgacgggggcggcggaggcggcggggcggctaacccagccggaggggacgcggcggcggccggcgacgaggagcggaaagtggggctggcgcccggcgacgtggagcaagtcaccttggcgctcggggccggagccgacaaagacgggaccctgctgctggagggcggcggccgcgacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtca

SEQ ID NO: 10671 - DNA, 3464 bp, Homo sapiens
  ENST00000519589
gacgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaaggtaatgcctttttatctccctccctgtctcttccacttcttcctcccccaagtccacttccttcctcacctctccctttgcccacttaagaacctttgactccacaaggtaactctctcccttccctcgacaagccaacttcttgcttccctaactcctcctgtcccttgggctgaggcattgtgatgtattcccaggagtctagggctgcaggctcccaagttaggagcctggaaacctgtcaccttggtttctaagggtccgccccgaccccccgccccatgattggattgttatggaggtcaacttgaaggatggggcggtgccaggtgcaaagcaatttagagaccagggcacgggaagagtggcagaaaagcgccctctggaggctgtaggagccatggcctcatgtgcctcttttacttatgcaaagggaggacatgcagaaaagcctgtttcctcagtgtctgagcccacccaggccctcaatcctcattgtatcattcagttctctccaaggcctctgatgtgtgcggctcagaaagtgacttctccaaggtcaccaggatagagactgacagagcaaaagtcccagctgaggcctgcacagtgtgtgttgtttgctggcttctgtgtcctttgctggcttctggctctgggggccactctggaactgcggagctcacttctcctccctgctagccttttccctcactaccagtcatgagctgcgcacacttttgacttggacttctgggtaatagaatgagggtgccaagaaaggctgaacagcatcacagcttgagaataccgtggagtcttgcaacgtggaaataaagactctggggattgacacatccagaggcgtggaaggctttgaccgaacagtggggtccccaagccttttccaggtctgtggcctgccgttcatatgtgtgtctccctcccagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgt

SEQ ID NO: 10672 - DNA, 2190 bp, Homo sapiens
  ENST00000638588
gtgtctgtgtgggaagggagagcaaacagaagcaggagggccatggtggcacaggcatggaggacctcaatgaggaagcagagggaggaagcgtgtttcaggttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagc

SEQ ID NO: 10673 - DNA, 822 bp, Homo sapiens
  ENST00000639358
acgaggggcagcggaggaccccgcagggcatcgggctcctggccaagaccccgctgagccgcccagtcaagagaaacaacgccaagtaccggcgcatccaaactttgatctacgacgccctggagagaccgcggggctgggcgctgctttaccacgcgttggtgttcctgattgtcctggggtgcttgattctggctgtcctgaccacattcaaggagtatgagactgtctcgggagactggcttctgttactgacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaa

SEQ ID NO: 10674 - DNA, 10659 bp, Homo sapiens
  ENST00000621976
aagccaaaaaagcatggtcctatgttcctgattgtcctggggtgcttgattctggctgtcctgaccacattcaaggagtatgagactgtctcgggagactggcttctgttactggagacatttgctattttcatctttggagccgagtttgctttgaggatctgggctgctggatgttgctgccgatacaaaggctggcggggccgactgaagtttgccaggaagcccctgtgcatgttggacatctttgtgctgattgcctctgtgccagtggttgctgtgggaaaccaaggcaatgttctggccacctccctgcgaagcctgcgcttcctgcagatcctgcgcatgctgcggatggaccggagaggtggcacctggaagcttctgggctcagccatctgtgcccacagcaaagaactcatcacggcctggtacatcggtttcctgacactcatcctttcttcatttcttgtctacctggttgagaaagacgtcccagaggtggatgcacaaggagaggagatgaaagaggagtttgagacctatgcagatgccctgtggtggggcctgatcacactggccaccattggctatggagacaagacacccaaaacgtgggaaggccgtctgattgccgccaccttttccttaattggcgtctccttttttgcccttccagcgggcatcctggggtccgggctggccctcaaggtgcaggagcaacaccgtcagaagcactttgagaaaaggaggaagccagctgctgagctcattcaggctgcctggaggtattatgctaccaaccccaacaggattgacctggtggcgacatggagattttatgaatcagtcgtctcttttcctttcttcaggaaagaacagctggaggcagcatccagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaagatgccgggacaggtgaccccatggcggaagacaggggctatgggaatgacttccccatcgaagacatgatccccaccctgaaggccgccatccgagccgtcagaattctacaattccgtctctataaaaaaaaattcaaggagactttgaggccttacgatgtgaaggatgtgattgagcagtattctgccgggcatctcgacatgctttccaggataaagtaccttcagacgagaatagatatgattttcacccctggacctccctccacgccaaaacacaagaagtctcagaaagggtcagcattcaccttcccatcccagcaatctcccaggaatgaaccatatgtagccagaccatccacatcagaaatcgaagaccaaagcatgatggggaagtttgtaaaagttgaaagacaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcatactctccacatatgcgccaattaattttttaacttacttattagtattcttgaagaacttactatcttaagtattttaccaatagatgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcccatttaagaaaacaaaaaggaaaagagaaaaatgatcttctggaataactctgctttgatattctccttttgttccccaaaaaatatattccagaaaggcaaaccaaacctgctcaagttgcctatgcacagacaatctcaacaatatggctcacagtgagcaagcagaaattcagggtctggaattgaatgtgagttatgggaagaaacagtgtgtgctttcacaaagatccttttgtcagacaagggaacagcatgataatccaatggaactggttaacatgacccaagatgacatgaccacagatatactagtcgttctgaaacttgcccaagaaattgcaatcgtttcagcagaactccatgaaatattgacaaattaattccatcatcaaactaggagtgatattatcaggtaaaactatgatctcatgtatgtatttggtctttctgggtcacaatgtgacatgaaaaattttaaaggtcatattttagcaagatcaaaatgaattagataaatcaacttcacaaatgttaagcgaaacatgatcctattgagctgagaaagaagtacttgagatcgtttgagttttgactatcaaatgtcagcacaaaagcaaatatcaaaagcttaagaaaaaaattatttcaggaaaagaaaaacacatcaaattgagaaagtgttgttgaataactttgtttttagaactggaaatttaggcttattagacatgacattgatattacaaagccctagttttcatgaaaacataactagataaccccaaggtgtataggttaaaatgaactaattaatcaacaattatgcatcctgtgtctattttgtgcaaggtacttcctagacactgtagtttgaaagaataatttcctgtagaaaaacctaatctaataggacctactcataatttggcaaaatcatcctcataattccatgctactgaaatgggggtgtaataaagaaaaaatcatttgtttattcatttaacagggtttattaagcaccaatatatgcccagaactttgcagtgcactggaagttcagagataagaaaaccacagtttctgccatcaaaatgctaggaatctagaggtctcaaacatcagaggtcccttcaaactatgtctaccaggaaaataaaatacctgatttcatccctgcaaacaactctatacagacagaaatgcttcctagcttggaaactatagaaaattgaacatgaaaatgagagcaaaggttctacatcaaaatggcaatgatccaatcagcccagtcaaggctgagtgggttgaatggggacttcgagtttggattcaatgctttgaacttcatagctccagagaagctgtgcaaaaaggggggattctagggaatctgaggaagattgttggagaaaccagctttcttcttgtctcctaatccctgctaagattgataccagtcaaggagctgagttactttcatttcattatgttgaccaagagaagcttatgatacagactatgacacagcacctatttcaagagaaagatgttactctacttatgggaacctgcagatcaaattctcctggggcaagagaagaaatttgttcagcagcctaagaagtcaactgtactttggacagtgctgccaaacacaccccaggattctcccacccctgtgctttcccagaagatgccacatagctggtatttggttttcatgaataaccaaagattcttctttgcttcctgaaccccaggcatccttaggaatttgcttcatgtcctcacttgtccttgaaggcttgtttttcaggatgaacttttaaagtctaagttgtttatattcaaatcaacccaatgctattgttgctgatattaaaccattccaaactgagccaactggcccctaaacaagccagcaggcagcccctcactaatgcccagtttagaacatgttaggaccaggctatctgcatagctttagtggttttagaagccagtaatggcagtgtaaaagaggaatcatacagagatgacctggaagaaaatttgagtttcagcacattcaaaagcatttgactcttctgccgtgttttgattttcaagtgagacaatcaatgtacacacaaagcctctagtacaatgactgatgcatactagggactgttatttatgttatttttttacagtatgcatggacttcattgtctcagtctttggtgttacttataaactctaaatttacaccaaaaaaattttttttcagaaaaagaatcgtggagaaacaatcctaattattaaatcaaatgctttcacaattgctttttaaataagtacatctctgcaaataaaaatgcttgctcttgtctaccacaataaagaacagaaggaatcttggaatgaagagaggcaggaatgttggatctcagtggctgagttgtggcaattccattggacatatagtaccagatgttgcaccatctggatgatgtgtaggagataaagccaaattgcaaaaataaaagactcatgatttcccaaggaaagtcaactgtgcatggtggctatcagacaacaccctagcaatgaatgggggaacttgcagaagaaagagttaatgcttgcttaaaccttccctggggagatttgttcccaggctttcacggctttaacctcagcaaccctgtaagaaaattgtgattcatattttgatttgttatcatagatgcaaagagacataatttcatggattctaagatacacagagcaagaagagattttgatcacccagaacaaccacctgtctttttagatcaagaagcagaagctcagagcaaagaacatcacaccacgtccctcagtgattgaagcagtgattgagtcacagaataaatctggaactcaggtcttctgatctttgctccagatgttagagacaaaactaaaagtaaaataccaagtgaaatcaaagcatcacgattgagcccagaacatgaaaaagaacttcctggcccacttgagaaactgttaaaccggacatacctttggggacttcttcccttctctggaataagattgatgtttccatgctgtgaaagacgatgatgttccttctcccagattcctgctgtcttcaaaaggcctagcaaaaaccactgctgctgggtgcagttgagaaagggaatgaagaacaatcccatggccatgcaggcactcctcccctccacctctctgccctccacccctctgccctctcctaccttgttccttcttggtcctgccatgtttggactggttcacctttttggcccatcacttgggctcattcagcaacagtcatgccttaggttgcatcctcatctataggccaattaaacagggtttcttcttgataaatccctatggttttgattttaggaagtcaggcatgatttcttttgggatctatatgacccaaagtggccagttttaccaaaggtgtccctttgcactgggatctctgggtctcatttgaacacagcttgggtcctcttgccttgtcccagagaatccccatgttgtcaggacataagcagatactctagggccttcaccaaaagctacaaagaagcagacaggactcaacttaggacatcttatggttatgtaactaagagattattttaggaagtaaacaggcctctgttggctcaaatgaacatcttcattgttagtttccacttacattgttctcgggataaatcggccagaatttggcagggctccccagcagtccttgtgaatccctgtggtaggatgtttcagttctcctgagtcaggctgaagtgaaagctcctaagagatattcagaaagaaggatggtcaagttctagaacaacaatagttggcccagtaattttaaagattgtcattctacctaagccttcatcctccagatagcactgttatgggcttaaaataagcttcaagggaaataatgaatttctttgacaccgccaaaaatcggctgtatataagaataacttgagaatggcttacaatgaggtagtcaaaagcccagctcagtgctcaggaatgtatttgtaattcctcttagacttgtcgaatggactgcaatttgatacctaagagtaataaaaaatgagaccatattttatgttaatgttcccttctcttcctctgcccacaaaagtgaggtcagggaaggggagagaaacttatcctaagcactccttatgagttgcttgtgacatgatagctctctctaaagttcatgcaatcctcatcgcaaccccatgagggagatgttattgtctccatcttatagatgaggaaactgaagacaagaccttgtcaaaggtcacacattgtaagaagtagagctgcatattcaaccaaagcccgtgtacctggaaagctcattctctctcccccttcttcctctcaaatcaggccctagctcctccacaatgcttcgggcttctacgttcactcagctttacagtaaaatgatcacagacccatgagttccctggagagtagagtgatgcctgggtcagctgttcctcttgtctgttcagcaggtcctttgagtggcttcacaatccagctgtcagtggcagaaaataatgcctcataaattattcacctggttcacattggaatccattagctctcggggcttggtgtggctgcagatcatccacaagtgccccttgttctctgcccccaaggagctcctgtcattgtttttaaccaaacaagttcaaatatctccacgtctctgctgactctggtcttttgtctctagactgtacctttatttctgagctctgaaattctgcagaaacaggtgagtctataaaaacattctgtgggaggccaaaagctcagaacagttgtgtctctctttctcagtattaaaagatcaaggtttcccatggaagccaacctgatctggtaattgggcccttctatacccctctgaatacttttccaaggagggggcagttcccacccccatagttcccctgagggttaagagtccaggtggtggccaagttgcaagatttggggcagccattttgccaaggatcagagatttgctgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtgatt

SEQ ID NO: 10675 - DNA, 6688 bp, Homo sapiens
  ENST00000342056
ggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtaagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctat

SEQ ID NO: 10676 - DNA, 3527 bp, Homo sapiens
  ENST00000628967
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgact

SEQ ID NO: 10677 - DNA, 6345 bp, Homo sapiens
  ENST00000370398
gggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataaa

SEQ ID NO: 10678 - DNA, 1469 bp, Homo sapiens
  ENST00000370392
ctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcaggtttgtgatttctctcttgctacatgtttgtttataaatctgatacctaccaggtgttttaaatgtgtctcatgtgagtaaaatcgatcaacaaatacaagatgattaaaagtgacctttcacaagattgcctgcaaa

SEQ ID NO: 10679 - DNA, 2830 bp, Homo sapiens
  ENST00000629977
ggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccttgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagcca

SEQ ID NO: 10680 - DNA, 255 bp, Homo sapiens
  ENST00000443915
ctggagttcgtgatgattgtcgtctttggtttggagttcatcattcgaatctggtctgcgggttgctgttgtcgatatagaggatggcaaggaagactgaggtttgctcgaaagcccttctgtgttataggtgaatatcagagtctcagatacctggactatgacaccaacattcttgtcttctatctcctgttttgcaatatttgattaatattaaaagctaacatccatggagtacttatcatggaccgggca

SEQ ID NO: 10681 - DNA, 321 bp, Homo sapiens
  ENST00000441538
gagttcgtgatgattgtcgtctttggtttggagttcatcattcgaatctggtctgcgggttgctgttgtcgatatagaggatggcaaggaagactgaggtttgctcgaaagcccttctgtgttataggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatggaaa

SEQ ID NO: 10682 - DNA, 649 bp, Homo sapiens
  ENST00000427928
gcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgacaagggccacattaagatcaatgggactgtcattctgatgtatttgtgacgtctgaccagcaaaggtccaagacccagggacaaccaggtgcttgctctgtgaatatcttgaaacacagtaaggaggatgatcatttctggtcaacaatgaaggtgctctttccctctctcacacactccatctaccagcaaatcagagaccactgcttatcttccttagagaggttcctgttgaaagttatttcgaagtcttccaatgataagtaaaattcaagttcttctcccaagaggaattaacctattttatttatcatattatgtagcagacattcacttgccaacacattttattgagtgccacataattttcatgtttataaaataaaatattttatttttcatttaa

SEQ ID NO: 10683 - DNA, 6539 bp, Homo sapiens
  ENST00000403813
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaatcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 10684 - DNA, 6236 bp, Homo sapiens
  ENST00000414165
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 10685 - DNA, 6566 bp, Homo sapiens
  ENST00000355194
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 10686 - DNA, 6596 bp, Homo sapiens
  ENST00000402622
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaataagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 10687 - DNA, 6623 bp, Homo sapiens
  ENST00000355635
actctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtttttctccctgtctttggttgcttgattttgtcagtgttttctaccatccctgagcacacaaaattggcctcaagttgcctcttgatcctggagttcgtgatgattgtcgtctttggtttggagttcatcattcgaatctggtctgcgggttgctgttgtcgatatagaggatggcaaggaagactgaggtttgctcgaaagcccttctgtgttatagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggaattaatcacagcttggtacataggatttttggttcttattttttcgtctttccttgtctatctggtggaaaaggatgccaataaagagttttctacatatgcagatgctctctggtggggcacaattacattgacaactattggctatggagacaaaactcccctaacttggctgggaagattgctttctgcaggctttgcactccttggcatttctttctttgcacttcctgccggcattcttggctcaggttttgcattaaaagtacaagaacaacaccgccagaaacactttgagaaaagaaggaacccagctgccaacctcattcagtgtgtttggcgtagttacgcagctgatgagaaatctgtttccattgcaacctggaagccacacttgaaggccttgcacacctgcagccctaccaagaaagaacaaggggaagcatcaagcagtaagttctgtagtaataagcagaagctcttcagaatgtacacctcacggaagcagagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatgctgacacagcccttggcactgatgatgtatatgatgaaaaaggatgccagtgtgatgtatcagtggaagacctcaccccaccacttaaaactgtcattcgagctatcagaattatgaaatttcatgttgcaaaacggaagtttaaggaaacattacgtccatatgatgtaaaagatgtcattgaacaatattctgctggtcatctggacatgttgtgtagaattaaaagccttcaaacacgtgttgatcaaattcttggaaaagggcaaatcacatcagataagaagagccgagagaaaataacagcagaacatgagaccacagacgatctcagtatgctcggtcgggtggtcaaggttgaaaaacaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacatt

SEQ ID NO: 10688 - DNA, 5883 bp, Homo sapiens
  ENST00000367433
acagcgtcttgttagtcctctccctgtactccgcaatattttctttctttctccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacagaatgctgctgctcctcttaaaaattaaatgtgtcatattatattctttaaacttactgttttacaaaattgagctcatcgtaaatgtctagtcttctcacatagagattaaccaacaaacttgtgtggctgacttttgtgtaagaatcatagtttgctttagaatacaaatctttaagtcattttaacttttttttctgccttacgatataaaaatatttatcttagaatttgagatgttcatagcatgttttattacattgaagaaactaaaacataaatgaaaagaaacactaggttcctgcactttttggtaactttatgtctagcaaatattttatgccaagaaaagcatactataaagcaaatatctattattctcctaaacgaatgcctagcatagagaaaatacttaatacacatttgttgacttaaatttaattcaaggattgaaaaattaactggatatcttgaaatatacagtaatgattgtccttagactcttgaactttaccatctttcctattcatatatctatatagtaaatttcactagaaaaattcttttaaaattgacagaagataatttataccttttatggactctgaagacacttcaaaacattaaaagtccttatgtctttggtaatgaaacaataacactcaatgaaggatgtattaaaatttttgacttaattttgaaatcgtatatatgagctatactttaacattatgagagaaaagcataaaacaaaaataggtagttcttggcttttaacattaatgcaaatcatgcagaatttgagttataaatttaaatataaattgaccattgatgatatccagtttttcattttttacctgtattgcattttccccctagagaaatagatcaaaagagcacaagagtatgcgtacatagtttaccaggtagtagaagtgtgttaaaatgttcctgtaaaagaaacattggtaaatttaaatacatactgttctaattttgtattttttaatttttgaatttgacattgagtttaattcagcaacaacaaaaaatacatataaaactagaaagggactttttttcctttcttttcataatgaagcagatcaacttaaaggataataaaatttttaaagaaaagatattctaatgtactctcaataattctacagaaataaaactgtaaagtgcaatgtgaaatcaaagattatagtcattgtataatttggcttggaggctatgaaatgtctttttttctttttggtattttacattattcacattttagaataacaagaacaccaagaattacccctaaaacagagaccctgtatttaatctactttgatcagagaagtagaatttataacaggttagctaaaattgggagcatgccttaaaacttaaagattgtatgcatatatgtgtatatgttataaacgtgaaatatatttgacacacacattcacatataaattgttaaaaactgaaggcagaatggaactaatatatgtaacagagaaaaacaataaattttatgaacttgttttatatttgcatatcaagagtcaagtatgatgtttctttaagttgactttttttacttcattatttttaggaataaatgtaagattttacaaatcttttatttccccacaagatctgaagtttggtatttttgcattatgacagttgttgagactaggattttaagctaggatatgattatatttcctatataactaaaaattttgtttcataaattttaaaataattatttttgactatgaacattagtccaaatttaatatttgacacagttcataccagcttgctacaataatgataatttattagtctttctgttatttaaagaataaaaacatgcttataaaagacttttaatgaaatgttgcctttttaaaataattatacttgcacatgaaaataaaatataaagtcaataatagtccttgtagcccaatgggaattgattctgtttattgtctgtaccattttgctaccagttacattgaactgctttaaaataaataataaaattatttctaatgatgaaaa

SEQ ID NO: 10689 - DNA, 5157 bp, Homo sapiens
  ENST00000498426
aatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagttttagccataaaatctctgccacagaccattgttcctgattcaagcgaaatattttttctggactactcctggggatcttggactcaaggctttgcctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacagaatgctgctgctcctcttaaaaattaaatgtgtcatattatattctttaaacttactgttttacaaaattgagctcatcgtaaatgtctagtcttctcacatagagattaaccaacaaacttgtgtggctgacttttgtgtaagaatcatagtttgctttagaatacaaatctttaagtcattttaacttttttttctgccttacgatataaaaatatttatcttagaatttgagatgttcatagcatgttttattacattgaagaaactaaaacataaatgaaaagaaacactaggttcctgcactttttggtaactttatgtctagcaaatattttatgccaagaaaagcatactataaagcaaatatctattattctcctaaacgaatgcctagcatagagaaaatacttaatacacatttgttgacttaaatttaattcaaggattgaaaaattaactggatatcttgaaatatacagtaatgattgtccttagactcttgaactttaccatctttcctattcatatatctatatagtaaatttcactagaaaaattcttttaaaattgacagaagataatttataccttttatggactctgaagacacttcaaaacattaaaagtccttatgtctttggtaatgaaacaataacactcaatgaaggatgtattaaaatttttgacttaattttgaaatcgtatatatgagctatactttaacattatgagagaaaagcataaaacaaaaataggtagttcttggcttttaacattaatgcaaatcatgcagaatttgagttataaatttaaatataaattgaccattgatgatatccagtttttcattttttacctgtattgcattttccccctagagaaatagatcaaaagagcacaagagtatgcgtacatagtttaccaggtagtagaagtgtgttaaaatgttcctgtaaaagaaacattggtaaatttaaatacatactgttctaattttgtattttttaatttttgaatttgacattgagtttaattcagcaacaacaaaaaatacatataaaactagaaagggactttttttcctttcttttcataatgaagcagatcaacttaaaggataataaaatttttaaagaaaagatattctaatgtactctcaataattctacagaaataaaactgtaaagtgcaatgtgaaatcaaagattatagtcattgtataatttggcttggaggctatgaaatgtctttttttctttttggtattttacattattcacattttagaataacaagaacaccaagaattacccctaaaacagagaccctgtatttaatctactttgatcagagaagtagaatttataacaggttagctaaaattgggagcatgccttaaaacttaaagattgtatgcatatatgtgtatatgttataaacgtgaaatatatttgacacacacattcacatataaattgttaaaaactgaaggcagaatggaactaatatatgtaacagagaaaaacaataaattttatgaacttgttttatatttgcatatcaagagtcaagtatgatgtttctttaagttgactttttttacttcattatttttaggaataaatgtaagattttacaaatcttttatttccccacaagatctgaagtttggtatttttgcattatgacagttgttgagactaggattttaagctaggatatgattatatttcctatataactaaaaattttgtttcataaattttaaaataattatttttgactatgaacattagtccaaatttaatatttgacacagttcataccagcttgctacaataatgataatttattagtctttctgttatttaaagaataaaaacatgcttataaaagacttttaatgaaatgttgcctttttaaaataattatacttgcacatgaaaataaaatataaagtcaataatagtccttgtagcccaatgggaattgattctgtttattgtctgtaccattttgctaccagttacattgaactgctttaaaataaataataaaattatttctaatgatg

SEQ ID NO: 10690 - DNA, 3622 bp, Homo sapiens
  ENST00000609185
ccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaatctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacaga

SEQ ID NO: 10691 - DNA, 4409 bp, Homo sapiens
  ENST00000294725
tttttccccgagttcagggaaacacctcccttctttcagaatgtgagaaaaaaatgggattttcctggggctgagagtggggattccctttccagaaacgtgcaattttttcatcccgcccacctggactgaaggcaatcaaagcgagggagctcgtggcatagtggaacactccaagcaccctggcccccctcctcccagagaagggtctggagccccgcaatccgctaattagctcgcccccattggttgtccccaaggcacccccgtgccgtcactgtgctatgctaatgagggggagtctcattggctgggcctccagctccatctccacagggagattgcggggagagccgggttggccgcgtctggggccgaaacccaccgcccccgattcccgccagctcagggctgtgccggatgcaagcccgcccgagggaacagtagccgggaggctgccctctgggaggatctggcaactgcctttaaggaaagtgcttcaccatcaagcggcgctcactcccacccctctcccctctttctaggcaccgcgcgtctttttcggcgaagtaactttttatacccgcctccccctagtcctggggaccagaggcggtgccgagcctgggggcggttccttggcagcgttgattcttgtcagagccagacttttgctcctgggttgggtttgcatcatccccattacaccctcgggaaagaggagccagccccctttcaagccttagcttccggctccaagcggaccccctccccctccctgtccccttccccttctcccatccctctctcggccacagcgtcttgttagtcctctccctgtactccgcaatattttctttctttctccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataacccgccagatatgcattttctggatgcaatctgttggtttccaatggtttactacatggtgggctctattgacaacctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatgga

SEQ ID NO: 10692 - DNA, 3462 bp, Homo sapiens
  ENST00000610076
agacttttgctcctgggttgggtttgcatcatccccattacaccctcgggaaagaggagccagccccctttcaagccttagcttccggctccaagcggaccccctccccctccctgtccccttccccttctcccatccctctctcggccacagcgtcttgttagtcctctccctgtactccgcaatattttctttctttctccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaagctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcagtgtgtgtgcctgtgttgcagagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaatctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatggtatgctctttaaaaactactgtatatatggactcgtgatttcttgccattagtagtaatatagttggttctaatttaataaagaattgaatttttgcttcacag

SEQ ID NO: 10693 - DNA, 695 bp, Homo sapiens
  ENST00000466914
tagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgttctgaaggctggaaatccaagatctaggtgccaacatgatccagtgctgagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaat

SEQ ID NO: 10694 - DNA, 3146 bp, Homo sapiens
  ENST00000451324
ccctcctctcctccatttgttgtttgatgtttcccactctttgaggaaggatggttgatttggagagcgaagtgccccctctgcctcccaggtacaggtttcgagatttgctgctaggggaccaaggatggcaaaacgacgacagggtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctggatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacagacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacttgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataacccatgacttactcaggtgtggagtgacttttgctgctaatatggtggttgtggataaagagagcaccatgagtgccgaggaagactacatggcagatgccaaaaccattgtgaacgtgcagacactcttcagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaagattttattggatctacttcctgacgttacttaaattgtctcaaatatctatcagtgtagaagagtgggaagacaccaaagactccaaagaacaagggcaccaccgcagcaaccaccgcaactcaacatccagtgatcagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacaga

SEQ ID NO: 10695 - DNA, 6979 bp, Homo sapiens
  ENST00000524391
agagcgggcggggcggacacgcttagcgtaagcgcaggggccaggagcccggagggaggtggaggcggggcaaggcaaggcagcaggcgctgggtagagctcagctggaacacagtttccctcctggaccggtcgagtcagacctcacgtgtagactaagaggatcaaaagaagagtacgttacctgcggcgccggttgtgcgcagaccagatgtgccgggagctgcaggaggtcagaacctaagggagacggcggaagaaaatggagcgtcagtgatcatcagactagaatgagagtgaattgggagaaaatggtgcggccccctcacccagagaaccctcccccacctgctcacacccccagcgaacaccccgggggaggcctatgaagcagcagtaaaagaaaagggaggaatataaattctcaagttggaagggacccggttaccacttcctttgctttctgaactttttgttttggtctcctgcgggcaggagtgagtctcgccatcccccttgcttgcttgcttgcttgcgttcagctaagagtcatcttctctcctcttcctcctcctccgccccacatctccctccttcctcccttccccaacccctccacccaccaagtagcgagtcattcaatctgtacacctcctgggctgggaatcgcaattgcgaagttgggaggcggggtgacaacgtttgggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggtgccaaacatcatagacctccttgccatcttgcccttctacatcactcttctggtagagagcctaagtgggagccagaccacgcaggagctggagaacgtggggcgcattgtccaggtgttgaggctgctcagggctctgcgcatgctaaagctgggcagacattccacaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagctaagaactagctcatgattcccattattttagtaaatgagattctacaacctaagaataacaaggaatgcatcactttaatacctacatttccaatataatagagcccccaaggggaagaaaattggttcttgaggaaaaaaaaatcttatcacttcatttacaaaacacagataagcatattgagtatatctgtggtattaacatttcatgggggtgagatgttagggaaaaaagcctagaaggctctttgccaggggtgaatggtgataagaaataaacattgaggactgctttaatatatagctataaggtatttcataaactctatttaagacatcatattatgctatgcactaccaagaaagaaagatgccagtcaattgtaagatgccattaactgtaaaatgcatccggatttcagatatgtaaaaatttaaaataagcaccttaaaatcaatgaaatatcgcatgtactacctcctgttttctggtatgcatggttaagctctgaaaacattttcactgatggcatgagttttagattgtgtgctaaagtactttaattcatttaacttgtttccacttctcctaaatattataaaaggttcaggagatatgaatattagtaagataaatattttacttcttacacacatacatgggtgctagattgtggcacagggccactagtcatagtataaatcccttccacaatctgaagggaaagtagaagttagacacagaaggtaaacttactccagcttttctagaactttccctaataagaatagttactctgatccaggactatgctctgtattcatcatgtattatgccattttatcctcaaaatatccctattatataattactattcttatactcttcaaaatacatattttatatatttattaactcaacaaatatttattaaggatctttggtgttctggggactagggagtctttcttaaacaagactaggtcctgttttcttgtagttaatattctgttcaaaggtgtgtgaggaaaagacagcgaaactgaaacattaaaaggtataaacttgcctaaattcacacaggctatagatggcagagccagcgctgaataccaatctgcctgacccggaaaacgacactcctaaaagtcaaattgcagatttcattcttcctacacaagctctgcatagaaatttattttttaggcaggcaagccaacttcttgtgcatggagaagttcaatatgccttaagtaaaatatcagcttattctcagaggtggaatggtgcttttaagaaaaggctgtggtgacaccttatagtcattattagattaaaaatatattatctttagagtaaatagtagttggaaataaaaaaaattaaaaactatgtgtatacatatgtatatatgtttttatcatggaggatcctaaacatcttctctacaaatgtgctgttagctatataaatgttgtcaagatgtaggtcttcagaaagaagttttaaaatatcattgcttactcaattttgctgttaaataaaatatcattttatttattcaatgaatgtatatataagcaaaccaaatttcatttaggtaaaaaaatcaaggcaggaactctgccaattttataacccattattttaaaacagtaaacactttttaaacatctaagaattattgttataaaacaatatttaattttttaaaatataaaataattgaattattgtctttctctaagctatttagagaacactactttctttgttttgttttggtttggttttttgagacggagtgtccgtctgtcgcccaggctggagtgccagtggcgcgatctcggctcactgcaagctccacctcttgggttcacaccattctcctgcgtcaacctcgcgagtagctgggactagaggcgcccgccaccacgcctggctaattttttgtatttttagcagagacggggtttcaccgtgttagccactttctttgttaatttaactgttattttaagttcagggatacatgtgcgggtttgttatacaggtaatcttgtgtcatgagagtttttttgcacggattatttcatcacccaggtattaaacctagcaccagttatttttcctgattctctccctcctcctacccagcaccctctgataggccccaatgtgtgttgtttccctctatgtgttcatgtgctctcatcatttagctcccacttataagtgagaacatgtggtatttggttttctcttcctgcattagtttgctaaggataatagcctccagctccatccatgtccctgcaaatgacatgatctcattctttcatatggctggatagtacttcatggtgtatacatacattttctttatccagtctacagttgatgggcatttaggtttattccatgtctttgctactgtgaataatgctgcattgaacatacgtgtgcatgtatctttataataaaacaatttatatttcttgggtatatacccattaatgggattgctggatccagtggtatttctgtttttaggtctttgaggaattgccacactctcacatggctgaactaatttacactcccagtatcagtgtatatgcgttccaattgctccataacttcgccagcatctgcttttttttttttgctttttaataatagccattctgactagtgtgagatggtatctcattatggttttgatttgcgtttctctaatgatcagtgatattgaggctttttttcatatcattgttggctgcatgtatgttttcttttgaaaagtgtctgttcatatcctttgcccactttttaatgggatttttttttcttgtaaatttgtttaagtttcttatagatgctggaatattagacttttgtagatgtatagtttgcaaatattttcccccaatctgtaggttgtctgttcactctgttgataggttcctttgctctgacaaagctctagagtttaattagatcccatttgccaatttttgctttcgttgcaaccaccttttgtgtcttcatcatgaaatctttgcctgttagaaaacactactttcagacatttaaatgcatataggcaatgcttaagtacctaaaaaagcaattttaagaaattactgaggtatctctattaagagtgacatattcatattttattttatgtatatattatttctataacatacaagaaattgttgcatttatcattttaatgcaaagtagtatcaagtataatggattagatgcaaaaataactgaggtaggaatctcagttctgtgttttaatgtggaattcttatgcttattaaaatattttgattagctgttgca

SEQ ID NO: 10696 - DNA, 2927 bp, Homo sapiens
  ENST00000297404
ggtgacaacgtttgggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggtgccaaacatcatagacctccttgccatcttgcccttctacatcactcttctggtagagagcctaagtgggagccagaccacgcaggagctggagaacgtggggcgcattgtccaggtgttgaggctgctcagggctctgcgcatgctaaagctgggcagacattccacaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagct

SEQ ID NO: 10697 - DNA, 1685 bp, Homo sapiens
  ENST00000308768
ttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcaggttacttgatgaagaaggtggtggtcctagggcattggagaagttatgcggcttgttcaaggtcatgcagctggaagatggtggtggtaggacaggaagtccgttgggcctgattctgctgccttctagtcaacgctcctt

SEQ ID NO: 10698 - DNA, 2528 bp, Homo sapiens
  ENST00000568000
gggattgggtgctaggtcccacgacattagctgggattctaagacctttgctcagctgctgcggccaccactgacacgccctctgctcctcaaatacggagaacagttcagtgttcctgcctgaggatctctgcatttgccttccctctgcctggaactcttccctcacatccgcttcccagcttcagctcggcatcacctcctcagagaggccttccatccttggtgcccgggcaccactgctacccgttttggcctctgttttttttttttttttcaaaggacgttatgttgcccaggctagagtgcaacggtccgatcacggattactgcagcttccaactcctggcttcaagcgctccttctgcctcggcctcccgagtagctaggcttacaggctggggttacaggtgtgagccacagcgcccggccgctttggcctcctttaagagcttccctccgcgctttgttcgcagttctggtcacagtctgttcagtgcgcggggctgggaggcgggaaactgcccaatgcccagacctctctgtctgtttcccctcaagctcgtgaagctctctgacagcagagacccaatcacgaggtggagacttcgctttccacatcgggcagggggtcggccgcatcctcgatctggtcctggtgactcgagaccagagaggagcgcacgtcgacccgcccggggaacccgcaggccacacgccaaacctctacgggatcccccagcgaggccactgcgcatgctccatactcgcagccccgcccccattcaggggcggggccgcgcctgcgcagctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactg

SEQ ID NO: 10699 - DNA, 1860 bp, Homo sapiens
  ENST00000566842
aaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccaggtgaccgccggggtgcggggcactgggcgggaccctgggatgcagcacagccctgcttctgcccaaggcgagggccacggccacacggggggcctacaagaacatctgtgcctgctcgcagattcggcttcgcctcttacccctgacgctctaggaactggcagagtcctcccccttgaggtcagtactgttgtgagctccattttacagatgaggaggtcgggacaccaagaggtgaagtaacttgcctagtgtcacccagttaaaaaatggggacaccaggacccccggggaggtggcctggctcccggtccctcactggagctgctgtgctgtgctgtgctgggatttgctcagcgcatgtggcttcccttctgagacccgtttagcctggccccaggggtggaggaggctctctgttgagcaccaaagccctgggcaggagcagaggactgggaatgcatccaggcccgtcttctgggggtacagagggaggggtgccaactgcgctgaggcctcctggtcccctggtccccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgag

SEQ ID NO: 10700 - DNA, 601 bp, Homo sapiens
  ENST00000568995
tactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaa

SEQ ID NO: 10701 - DNA, 806 bp, Homo sapiens
  ENST00000563955
gaggcactgtgtgacctgcgatctgaatggcatgacggacacgccacgctgacagctgagcaaagaagcatcccgggcaggggcacagccagtggccggggcaggcacaagctggatgtgtgaagcagcaaggtgtccgtgggaccaaggcccagcaagcaaagggagagtggcagagaggctggcggagcttggagcctgcagagccctgcggaccactgaggagtctggagttgttcccaaccagcttttgaaggcttttaagtgggggagtacgtggcctttggttgtgctgttaaccaccttccgcttcttccccagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaa

SEQ ID NO: 10702 - DNA, 440 bp, Homo sapiens
  ENST00000563264
aggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccaggaactggcagagtcctcccccttgaggtcagtactgttgtgagctccattttacagatgaggaggtcgggacaccaagaggtgaagtaacttgcctagtgtcacccagttaaaaaatggggacac

SEQ ID NO: 10703 - DNA, 264 bp, Homo sapiens
  ENST00000566413
caatcctcaattacctgcgggatgggtctgtgccactgccggagagtacgagagaactgggggagctgctgggcgaagcacgctactacctggtgcagggcctgattgaggactgccagctggcgctgcagtccagggcatactccggtttctccagttgttccagaaatgtgtttttacagctggttcatcaaaccagggtccagtctagatcttcacgttgcatctggttatctgcaagttaacaatggaaagcatgacttt

SEQ ID NO: 10704 - DNA, 1773 bp, Homo sapiens
  ENST00000561540
gcgcctgcgcagctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcaggtgagggccttcggagtccccatgcctatgttcctgggagagctgcccaagcaggtattagagcagaaaaaaggagatatggggtatggcttggagagcctggctttggctggccataaccccagagaatttgaggtgccatcttctgcatccctgccgcctcaggcagcacccccaccccagcctcatgccaggacctttgcaatggttaaatagctgctctctacttcccactgttcctatgcagccagtccagctgttacactcgcacctgagtaattatctttcagcacaaccccgatctattctctctcttgcttagaaatcctaaatagctccctcatgtcactagggaaaaacatctaaatttaaattgaaatataataacctctgcgatctggccctatcctgggaggcagcattctcccatggcttccgccccccaggagctttctaattcttttttttttttaaacagtgaaattctttattcaaatgaaatctcacagaagcagggccactcccagtaaaacagggttggggattctagagaccccacctgctaggctccacttttgtggaccccttagggttctgaggagcagagcttggaaagtgaagccaggacataagggttctgtgtcacctctgtcacagctgactcagtgaccttcagtgagtccattcctacctctgggattctgtcctcgggttccgaaagacagggaagggagaaaaataagtacaaagtagtgagttttacataaagcctgttattctgttctatttttacaatgttaaaaatgtcctttcttttatgttacaatagtaagagaagattataaaagtttctttttgaatgccctttatagattaaaaggttgcctccctgaacaacttttgtctcagggaatacttactggttcttgaagcccaaaggtgtagaactcctttggacaatatccatgtttttcaaactttttgattgcctgccatagggaaaaaatgcattttagtactcattatatataactgaaataacagttctataaaaagatacttttagtgaaatgtactctgataatctttctttttaatgctgtttgggacccattacttatttcatgacccattaataaattaccacttgcatttg

SEQ ID NO: 10705 - DNA, 589 bp, Homo sapiens
  ENST00000568721
ggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggagcaataaccaacacttacggaacccctaactgccaggcgctgtggttgggtgctgattgaccggagcggccgtcactttggtacaatcctcaattacctgcgggatgggtctgtgccactgccggagagtacgagagaactgggggagctgctgggcgaagcacgct

SEQ ID NO: 10706 - DNA, 856 bp, Homo sapiens
  ENST00000532831
cccgggccggaagggctcctgcgcaggcgtttgtagccacttttaagttttatcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagcttttagaagttgcctgcattccttggccccttcctcacatcattccaaccaacttccatccttacaatcgattactttcctgtaatagctacagtcaaatgggcagctgaagatgatgatgatgatgatcttgacaccgagaagcagaagaccaatgaagatgaccagacagcaaaaaaggataagttaaaagaaggtaaaagaaggccactcgtacttgctgtctcagtatctaaaggtggtcaccttccagtagagaggcccacccactgcagaccgtgccaccgaaggtgacatgcactttctgccacccatccaaaaccgtaacgtgaatctgcaacaggagaggaaagaagaaccaaaacttccaaggccttgcattttttcttaaaagcatttttttttttttttggagatggagtctcactctattgcctggagtgcagtggcgtaatttcggctcactgaagcctctgcttcccgggtttaagaaattctctgcctcagcctcccaagtagctgggattacaggcacatgccaccacacctgtct

SEQ ID NO: 10707 - DNA, 555 bp, Homo sapiens
  ENST00000523626
gcaggcgtttgtagccacttttaagttttatcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagggtctcgctctgtatcccaggctggagttcagtggcacgatctccgctcgctgcaacctccgcctcctgggttcaagtgattctcctgcctcagcctcccaagtagctggattacagagcatgtgggtgagaagaatcgatgcagaagccatcgctcagagcgattttcagtacctcttccacgaagacctggaagctgttgatctgcttgttggcgggcaccacccagagcctcttgaggttctgcttggtgtactcctcctctggcaggccct

SEQ ID NO: 10708 - DNA, 910 bp, Homo sapiens
  ENST00000530261
aggcgtttgtagccacttttaagttttatcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagctacagtcaaatgggcagctgaagatgatgatgatgatgatcttgacaccgagaagcagaagaccaatgaagatgaccagacagcaaaaaaggataagttaaaagaagggtctcgctctgtatcccaggctggagttcagtggcacgatctccgctcgctgcaacctccgcctcctgggttcaagtgattctcctgcctcagcctcccaagtagctggattacagggccttcttacagatggataaatgcggcactggctagcggtacagagagatggagcccaggagaaaactgctgctcttttgtcctggctggaaaatcctcctatggcctcctttagtacacatcagctgactcttcacttgtcataataaaccgcctgtctgcagctcaaaatggcaagaaaaaaggtggttctgttcagaggacactggattccaaaaggtggacttcatcatggggggaatcaagtcctgctacacaattaatacagattagtatagtcccctgcctcgcaccactggcgagatgccctccaagacctggctgacatgagcttcctgggactccccatctccagtgttgttggggtccttttacctgtaccgtattaatcgaataatcttattgt

SEQ ID NO: 10709 - DNA, 1789 bp, Homo sapiens
  ENST00000500113
gtagccacttttaagttttatcagctagttcatgcttgcgttgaaagagtggtcgtttgcgctgggtcatcactgtgtagtattggggatacttagttctgtaaaccagaaatctaaaatcagtcactggagtaaagtcaaggtgtcatttggattggttgcttccagaggctctgcagggagattgtttttcttgtctttttcagcttttagaagttgcctgcattccttggccccttcctcacatcattccaaccaacttccatccttacaatcgattactttcctgtaatagctacagtcaaatgggcagctgaagatgatgatgatgatgatcttgacaccgagaagcagaagaccaatgaagatgaccagacagcaaaaaaggataagttaaaagaaggtaaaagaaggccactcgtacttgctgtctcagtatctaaaggtggtcaccttccagtagagaggcccacccactgcagaccgtgccaccgaaggtgacatgcactttctgccacccatccaaaaccgtaacgtgaatctgcaacaggagaggaaagaagaaccaaaacttccaaggccttgcattttttcttaaaagcatttttttttttttttggagatggagtctcactctattgcctggagtgcagtggcgtaatttcggctcactgaagcctctgcttcccgggtttaagaaattctctgcctcagcctcccaagtagctgggattacaggcacatgccaccacacctgtctaatttttgtatttttaggagagacagggtttcaccgtgttggccaggctggtcttgaactcctgacctcgtgatccacctgccttggcctcccaaagtgctgggattacaggcctgagccactgcacctagccaaaagcattttttaaagaaaaattggtctatattttttgtttctactttatatctttgtacatatttttagagtgcaggcatttttaataatcttggatgaccaaagcagctttcagaatgttctttgcccaacttctgactttacttgtagtgtgaccatgttcattagaatctcaaaggaggaagaaaagaaaaaacaaacttgtaaaaaatgaaaaatagatctggcgaggtgattcacggctgtaagcccagcactttgagaggctaaggcgggtggatcacctgaggtcaggagttcgagaccagcctggccaacatggtgaaatcctatctctactaaatatacaaaaattagccaggtgtggtggtgggtgcctgtagtcccagctactcaggaggctgaggcaggagaatctggaaccccggaggcagaggttgcagtgagccgagatcgcaccattgcactccagcctgggcgacagagtgagactatctgaaaaaaagcaaaaataggccaggcatggtggctcatgccttgatcccagcactttggtaagcctaggcaggtggatcacttgaggtcaggggttcgagaccagcttagccaacatggtgaaaacctgtctctactgaaaatacaaaaattagccaggcgtggtggtgggtacctgtaatcccagctacgcgggaggctgaggcatgagaattgcttgaactcaggaggcggaggttgcagtgagcagcagtcatgccattgcactccagcctggtgacagagtaagactctgtctcaaaaataaataaatgcaaaaacaacaaatcttattttttcagcctgttcgatgtatgtgtgaaacaatgttgtccaacaataaacgggaatcttattttt

SEQ ID NO: 10710 - DNA, 586 bp, Homo sapiens
  ENST00000527321
aagttttatcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagctacagtcaaatgggcagctgaagatgatgatgatgatgatcttgacaccgagaagcagaagaccaatgaagatgaccagacagcaaaaaaggataagttaaaagaaggtaaaagaaggccactcgtacttgctgtctcagtatctaaaggtggtcaccttccagtagagaggcccacccactgcagaccgtgccaccgaaggtgacatgcactttctgccacccatccaaaaccgtaacgtgaatctgcaacaggagaggaaagaagaaccaaaacttccaaggccttgcattttttcttaaaagcatttttttttttttttggaga

SEQ ID NO: 10711 - DNA, 554 bp, Homo sapiens
  ENST00000528468
gacgtgggtcagcttgttaacggatacaagaaggcagcagagggaatatgcctggacatggccttcttacagatggataaatgcggcactggctagcggtacagagagatggagcccaggagaaaactgctgctcttttgtcctggctggaaaatcctcctatggcctcctttagtacacatcagctgactcttcacttgtcataataaaccgcctgtctgcagctcaaaatggcaagaaaaaaggtggttctgttcagaggacactggattccaaaaggtggacttcatcatggggggaatcaagtcctgctacacaattaatacagattagtatagtcccctgcctcgcaccactggcgagatgccctccaagacctggctgacatgagcttcctgggactccccatctccagtgttgttggggtccttttacctgtaccgtattaatcgaataatcttattgttcataaaatccagagcatgtgggtgagaagaatcgatgcagaagccatcgctcagagcgattttcagtacctcttccacgaagacctg

SEQ ID NO: 10712 - DNA, 1549 bp, Homo sapiens
  ENST00000600795
cctgtaccgtattaatcgaataatcttattgttcataaaatccagagcatgtgggtgagaagaatcgatgcagaagccatcgctcagagcgattttcagtacctcttccacgaagacctggaagctgttgatctgcttgttggcgggcaccacccagagcctcttgaggttctgcttggtgtactcctcctctggcaggccctccacattggccacccagtccagagtcaggtggttggggtcctgcaagtggctggtgatggaggagagattgccattggagcagtagaagagcttagagccaaggagcttgaggaagaggcaggaggtgctgaagatgttggcgttgaagacctccatgctggaagaggagaggctgtagatctggggtgcctcgcgcacagtgaagtggaccgtctgcacacgctggttcagtgtgatgttgagcatggcattcttctcggccttggagagctccacttccttctcctgcagggcctcaatcaggggctgcacctggtagaagtcggcctccctgcggagcagccccatctcctggaagtcctcaggcaggtcaaggtgggaggtccgcaggaagttgaggatatagcggaacactttgccgtcacggtcaatgaagcagttgccctggctgtccctcttggtgggcatcttcccgctgaacatggcgcctagcatggagtcagggaagctggtcagggtcgccagtgaggttgtatagagcttccccccgacgttcagcgtgatggggtcggacatggcaggagactgggttgctggaagtagtcctggagagggtgagaagtgagaaatgactataaccaaaccttatcagagaactcacagtccttaactccttattgtacatcaagcctatgcccttgggatcgaaatgaattaatacctgatgaatgggtgataattgctaacactgtgcaaagtacattagcttcactagggagagggaaaggagaaagggaaaaggaaaggaaaaaggaaacagggaaagaaagggaaggacccctaaagcctgggtcccccgcgcccccctctgctgccgacattctattttaattggtctggaatactgccccagccctggtattttgaaagagttcccttagtgattctaaatgttcagttagaatagagaaccactggtctaaagaaagaaaggaaaacgtgcctggactgaaagctatgctacgtgtttatacatatatttgcttacataatagttgtatcagccaggtgcggtggctcacacctgtaatcccagcacttagggaggccgaggcgggcagatcacctgagatcaggagttcaagatcagactggccaacatggtgaaaccccatctctactaaaaatacaaaaattagctgggcatggtggtgggtgcctgtaatcccagctgttcaggaggctggggcaggagaatcatttgaactcaggaggtggaggttgcagtgagccgggactgaacaactgcactccagcctggacaacaagagtgaaactctgtctc

SEQ ID NO: 10713 - DNA, 3931 bp, Homo sapiens
  ENST00000259154
gtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcgtcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaatgattatgtcaa

SEQ ID NO: 10714 - DNA, 751 bp, Homo sapiens
  ENST00000448333
atttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagagtgttttggctgggcacggtgggtcacgcctgtaatcccagcactttgggaggccgagatgggtggagttcaagatcagcccgaccaacatggtgaaaccccatctctactgaagatacaaaaattagccaggtgtggtgatgcatgcctgtaatcccagctactcgggaggctgaggcaggagaatcacttgaacccaggaggtgg

SEQ ID NO: 10715 - DNA, 589 bp, Homo sapiens
  ENST00000452413
tgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagtctgtgtggtgtcagtttggtttctagatccagccaagagcccacataactaaaagggcatttggagaatatgtgagatccaggctgttgactgtactacaatatcctcatttacagtgagggaatgtgaggg

SEQ ID NO: 10716 - DNA, 2722 bp, Homo sapiens
  ENST00000495537
gctcaagaatgagactaggatagtctttatcactacatgtgggcatgtaggaattatctttttccctcctttttgtccggcctactaggaagctcatctaagcttcatattctattcctgtatgcttctcaaattcatgtggattgtatttttttttgtctatttttttgaccttgcgtttgcctatactgatttttcttttttaataaactccctcaactcttttgaagtaggctgggataactaattcagtcaagtacaattcagttagcccttacgtgactttggaacaatcatttgctgatgttatcccattgtttcctgatccgtcaatgtggataaaaattgttctctctcaggttcttttatcttttatgaaaatcaactaaaaagtcataaaaatctttttttgaagttgagtattatcctaatgatggatacaatatgggccatctccatagagctgtatattttttctggtttcagattttaaagatttacacataaattttaaatgattttttaaaagtcttttctagtataacatgtttgctttctttctttctgtctttttagtttcatagcttctttttaaataattgctcattcccatcagggctctttctgcttttcttttgcagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataagggtaggttctcatacagaaagatgtttgtcacaaggttaagcttttcacttaagtgattttaatgactatttgttctcctaagatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcgtcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaattta

SEQ ID NO: 10717 - DNA, 652 bp, Homo sapiens
  ENST00000465650
gagctgtatattttttctggtttcagattttaaagatttacacataaattttaaatgattttttaaaagtcttttctagtataacatgtttgctttctttctttctgtctttttagtttcatagcttctttttaaataattgctcattcccatcagggctctttctgcttttcttttgcagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacag

SEQ ID NO: 10718 - DNA, 1728 bp, Homo sapiens
  ENST00000216014
ccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacaccttattgtcaa

SEQ ID NO: 10719 - DNA, 931 bp, Homo sapiens
  ENST00000409006
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaaaa

SEQ ID NO: 10720 - DNA, 970 bp, Homo sapiens
  ENST00000471268
aacgacgactcaagtgatccgatgggaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagacc

SEQ ID NO: 10721 - DNA, 6031 bp, Homo sapiens
  ENST00000375401
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtt

SEQ ID NO: 10722 - DNA, 5677 bp, Homo sapiens
  ENST00000404049
ggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaa

SEQ ID NO: 10723 - DNA, 5245 bp, Homo sapiens
  ENST00000375379
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccc

SEQ ID NO: 10724 - DNA, 5122 bp, Homo sapiens
  ENST00000375383
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagagattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccc

SEQ ID NO: 10725 - DNA, 297 bp, Homo sapiens
  ENST00000477109
caactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaaggtgaggacgcttggagtgctgatgagggatcaaggggaccaggggacctgagcagcaggccatgcttggctcctttcaaaagcttaaagtgttcaggcaagacaggacacacgt

SEQ ID NO: 10726 - DNA, 1403 bp, Homo sapiens
  ENST00000497100
cagatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagtgagtgatgggggggatggagggactccacaggcaagttctattccctttcttctgtactctgacccccttcctctgcctctattcaatactgcctactctttgctgccctcatttttcttccaggccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctgg

SEQ ID NO: 10727 - DNA, 720 bp, Homo sapiens
  ENST00000465402
cctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaaggtggggagagtaccccagatcaagcaccctattctggtggaagttcggggaggcagaggcagcaccaagaagatgtagcctctactcttggcgtatagtgaaaagaactagatgcatctcgattgaaaaccacataccattctctgctataccctttaccagcaaccttaagtcgatttacttcattgtcagttttcccctctgaaaaatgggattatgataatgcttatctttttggatagttgattgtattaaagataatgtttgctta

SEQ ID NO: 10728 - DNA, 1361 bp, Homo sapiens
  ENST00000481369
atagagactttctttaaaaaaagaaaagtaggttcttcacaccatttctcaggaaactgttggaggatgttcttaagcatagcaaaggaataaaccaagaaagaggaagacgtgggatctaggaaataggagatctgtcacaagagagtgatgatccagggaggacagctggtccagattgggacagatcagaaggttgcatgagactgctacagaaagatgaaaattgataggaaaagagatttaaatattggtcagaaaattagggatatatgcataaaaaactgagcaaattgagaaacaggaggctgtttttaacatagtctagaagcatgttatttaaggtagttataatcaacgccaaaataatcagaagaggtggaagtgattggctgtggggaagggagaatggcaaggctggctgattttataacagatctttatagagccatttgactctacaaactgcatatataactgatgaaagtaaataactaaaaaagcttgtccagcttgattaaaagtgatatttataatttttgcaaaaattactaaggaagttggaatattttgacagatatattttttaatctcaaatcttcctatcatctcaacacacatcaaaaccttgagagcagagaccagtggtccttcctttcagagttggagagtctgggattctgttgtcagactgtgttccctgaggcttttctttgtctccttaattaccttgcacttaagtcaggtctgtatacaggaaaatctctatctcaacagccatggccttttgtgttcttcaggttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaaggtggggagagtaccccagatcaagcaccctattctggtggaagttcggggaggcagaggcagcaccaagaagatgtagcctctactcttggcgtatagtgaaaagaactagatgcatctcgattgaaaaccacataccattctctgctataccctttaccagcaaccttaagtcgatttacttcattgtcagttttcccctctgaaaaatgggattatgataatgcttatctttttggatagttga

SEQ ID NO: 10729 - DNA, 394 bp, Homo sapiens
  ENST00000497995
gcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttgtaaggacccagccctgacttcttaatgctctgcttcttgtcccttcaataagcattcccctgcatggcactggaccagtt

SEQ ID NO: 10730 - DNA, 870 bp, Homo sapiens
  ENST00000429877
tgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggcaggtgtatgagagaggatctacaggaagccttccagactgggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctg

SEQ ID NO: 10731 - DNA, 600 bp, Homo sapiens
  ENST00000495519
cgggcgtggtggcgtgcgcctatagttccagctactcaggaggctgaggcaggaggatcacttgagcccaggaggtcaagtctacagtcagccgtgattgcaccactccattccagcttgggcgacagagcaagaccgtctcaaaaaaacaaaaacgaaagaaatgagagtgaggtggggctaagcactgcctagagtctgggatccggttcattgggagaaaccctgggtagtgaaagtgtggagtgctgtattcctctgttctcccctaagactggacccaaagatagtggtcagtgggagggggtggccagcctctttgagccatttcttcttcaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccc

SEQ ID NO: 10732 - DNA, 446 bp, Homo sapiens
  ENST00000467093
atcctcccattctttgccaccacagtcaggcatcccagcacttacccccaccccctggggcttcctcccctgcctcttcctgtaccaggcaggtgtatgagagaggatctacaggaagccttccagactgggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcc

SEQ ID NO: 10733 - DNA, 766 bp, Homo sapiens
  ENST00000428012
ggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagagttccagctactcaggaggctgaggcaggaggatcacttgagcccaggaggtcaagtctacagtcagccgtgattgcaccactccattccagcttgggcgacagagcaagaccgtctcaaaaaaacaaaaacgaaagaaatgagagtgaggcccagacgagagtgaaactgaactacttggaccagattgccaaattctgggaaatccagggctcctccttaaagattcccaat

SEQ ID NO: 10734 - DNA, 548 bp, Homo sapiens
  ENST00000349663
agatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgtcaggcatcccagcacttacccccaccccctggggcttcctcccctgcctcttcctgtaccaggcaggtgtatgagagaggatctacag

SEQ ID NO: 10735 - DNA, 6096 bp, Homo sapiens
  ENST00000452825
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtga

SEQ ID NO: 10736 - DNA, 5501 bp, Homo sapiens
  ENST00000469599
tgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagtgagtgacaggaaatggaaggaacccttgtgatggacactccacagctgaccttgactgaactccgggtccttcttgagcagatgggcagcctgccctgtgccatgcatcagattggggatgtcaaggttctttcctggaagtggcggagatatgtgttcccataccatctctgtgtgtacagcatgcaaggaaatatccttccagactgaaataattaaaaactctaaactgggcctacataagacactggctcttgggaatggggtggagaggactgattggttggttggttgatttccctccagacaccagagtcttagaaagcttactagatggataagattgtattaaagtgggtttggaaaaagaaatttaggtaattaaaggagaaaaatgtcattctaggtaaacagagggcctttgttattatcagatagatcatgttttaggatgtggttgagaataagtattaagcaataggaaatgcctataagagaagatgagaagtggagcaaatctaggtggttgagtatttatgtggctaaagaatctgcattttatcctatgtccttgcaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctggtaagacaggtgtggtttgggtaggctgttggctaaacataactgagtgacccatgtatttgtcacctctgttgtggccatggaggataagaccaagagtggcctctaacccagtctgtccctgcacctttcaccgcaccaccttccgcccagacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaatatgatttgaacttcttaaattgtacgagtgaaggactgaggttaggaaacaacagtagcatgggtcaacgtaatttttaatagtctttttcggggcagtggggaagggtaaattttacttagaaaacatacatgagacttaggccaaggttaatgttttctcaaaggatgtccagttgacccagcaccagcaatagaaaacttacctgtcctacacttaattgctttgtgctttttattgaaaatctgttggctggacttgcatgtgccaatatctgagttaacttgttgcattgcatcatttaactatgtgtctgtcccctgtggccagatcacaatgtcttggttacagtcgctttataataagtcttacatcagggtagacagattcatctcacttttttgtttttcagattgttttagcaagttaagtcaccagctctctttttcattatgtagtagcttttgtgtcctaaatctgattaagttgcactgacacaagttatctccctcaatattttctgttctttcaactggtgaatacaatagctaatctaaatcatttgttgtaagaattcagtaggattgatgtgtaaatatttcaggtaaaaccactctattagtataccactaattcaattcacggttcttgttttgtgtgtctctgggtgatctaataatacagactgtattatacttcttttaatccctttaaaggtgaacgcattctgtcatcctggattgaatctctcgcttttccacctactccttgctgacttgagtcagtgtagaacacgttattacccatagcatttctcatgcctataatcatacctaccttccttattgtctactcttttcacctctttctttctttgatactgtcatagggaactataattagctttcccagtaacaaagctatgcttggtgatgacctagtagagtagaaattgcttcacctgtccaagtacagtgtactttaccttaccacaccatagggaccaggtaaaatatatagaaaatcctgagataatttatctaaatctgagaattgtcttcgaaatttcttttttctcctcttccataaataggaggaaagtcatgattctcaagccattacagattctctgacacttgttaacggaaaattctgatgaggcatgatgagaacttctgcctataaaaatctcactaaagttctgagtcacaaattgttcacatacttcacagtaagcaggcaatccaatgtcaggacagttgtacacctttcttaggttgcctcccctaattggggctgtatttgacatgaggggccagttttgacactttttaaaaccatacacaaggatgcagcactaagtttttgcacataggcaagaatttatcttgtgattagaagttagttatatgttcattaagaaacatgacgaaatctgcagcaaaaattgaatttcataggccattcagtgttctctgcgataattctaattcagaaaaaaattgaatcttggtttaaaaaaattgtaataaaactttaccactggtaa

SEQ ID NO: 10737 - DNA, 5472 bp, Homo sapiens
  ENST00000317961
cggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaa

SEQ ID NO: 10738 - DNA, 5134 bp, Homo sapiens
  ENST00000382806
aaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatact

SEQ ID NO: 10739 - DNA, 5235 bp, Homo sapiens
  ENST00000492117
atgtcatggagctttcctcttatgtcttcttttagtagtttgataattttggattttacatattttacatttaagtttttacttcctttggggttggtttttgtacatggtgaaagatgggtcaagtttcatccttttgcatgtggatatccaggttttccaacaatggatactgaagagactttcctttcctctctgtgtgttcttggtgtctttgtggaacttctgttggctgaaaatgcagagatttatttctgggctattattttccatggagctgtgtgtttgtttttaatggcagtactaagcccttttagttactatagctttgtgatataatagtaaattagtgtgaatactctcagcttttttgtttgttggtttgttttgtttcacatattgctttgggtattttgagtctttggggttccatatcaatttaagggttgcttttttgaaaatttctgtgaaggatgctgttatttttgacagggattaaattgaatttctagatcagtttggatagtatggacattttagcaatattaattcttgtggtctgtgaggacaaggtgtcttaaaatttctttgtgtgttcttcagtttacttcatcattatttgtatagtttgcagtgtagttatttttttacctctttaaatttattgctagagatttttttcagctgttacaaatgaagtttttattttgtttttttcagataattttctactaatgtatacaaacaccactgatttttatattgattttgtatcctgcaaatttactgaatttgttagttctaacaccatttttacggaggccttagcatcctcttaaaaaagaagtgttttctttaagacttttttataaatcttcaaacagggataacataactttctcttttccaatttgaatgtttttttaatttcttttcctgcctcattgctctggctgggacctccggcactgtgttagttgacagtggcaaaacagggcattatttttgagtttacaatatggacctcttgtgaccaggaataccagaggcagcatgttctaagacacagttgtcttcttatgtatgttttgctcagtttgcctctcctcatcgtatcctactccctactcactctggcaaatctctgacccaacaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagctttccttacaaggttgagtccacatcagggctcagtgttggctgaggtggggtgtccacaaccctactcctagtctttacagtatatgtgggttgaacacccccagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctggtaagacaggtgtggtttgggtaggctgttggctaaacataactgagtgacccatgtatttgtcacctctgttgtggccatggaggataagaccaagagtggcctctaacccagtctgtccctgcacctttcaccgcaccaccttccgcccagacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttgg

SEQ ID NO: 10740 - DNA, 4701 bp, Homo sapiens
  ENST00000440077
cggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggct

SEQ ID NO: 10741 - DNA, 880 bp, Homo sapiens
  ENST00000415360
ctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgacc

SEQ ID NO: 10742 - DNA, 792 bp, Homo sapiens
  ENST00000485154
aacttgtcagtatcgctgaacttagaaaaaaacctttgtgggtattactgaaatatgaaagggaaggaagtatattaaaagtctcaaattgtttgaaatgtgacattacgaggtgttccttctggctcctataggatggacactccacagctgaccttgactgaactccgggtccttcttgagcagatgggcagcctgccctgtgccatgcatcagattggggatgtcaaggttctttcctggaagtggcggagatatgtgttcccataccatctctgtgtgtacagcatgcaaggaaatatccttccagactgaaataattaaaaactctaaactgggcctacataagacactggctcttgggaatggggtggagaggactgattggttggttggttgatttccctccagacaccagagtcttagaaagcttactagatggataagattgtattaaagtgggtttggaaaaagaaatttaggtaattaaaggagaaaaatgtcattctaggtaaacagagggcctttgttattatcagatagatcatgttttaggatgtggttgagaataagtattaagcaataggaaatgcctataagagaagatgagaagtggagcaaatctaggtggttgagtatttatgtggctaaagaatctgcattttatcctatgtccttgcaggatgtcctggaacaggtggaggcctatcaagctgaggctcgtgaggctctggccacactgccctctagtccagggctattgcggtccctgttggagagggggcagcagct

SEQ ID NO: 10743 - DNA, 856 bp, Homo sapiens
  ENST00000478891
agctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagtgagtgacaggaaatggaaggaacccttgtgtaagccttatttctttcttttgggtattctcaaccttccttttctgctaacactgcctacctgttgcaacttacactctccaggctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggtacgtgagaggagaaggcaaagaagggtgtcagtgtgtgaaaatgaataacaaaaatggatagactataaacacacaatcctgtttgaggctgaggcaggagaattgtttgaacccaggagacagaggttgcagtgagccgagatggcatcattgcactccagcctgggcagcaagagcaaaactccatctcaaaacaacagcaaaaaaaaagaa

SEQ ID NO: 10744 - DNA, 1336 bp, Homo sapiens
  ENST00000447300
ggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccag

SEQ ID NO: 10745 - DNA, 5579 bp, Homo sapiens
  ENST00000541639
cattttaaaaaagatccggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaagagacaaagtctcactgtgttgaccaggctgatctcaagcttctgggctcaagcagtcctcccaccttggcctcccaaagtgttgggattacaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatg

SEQ ID NO: 10746 - DNA, 2812 bp, Homo sapiens
  ENST00000355265
attttgtcatcgcaacactaaacctttgtcggtctggtgctccccaattcatgaattgcttcttacttaaataaactctttaaaattttactgtgcctcatattttttttaatacagaagaaatgagagaaggaagaatattttagaaataaaggaacttcatgggcagagtcacagtgcaagacaaaaggagcagaccaagggcaagattgcttggggagtgaagactccctccctcttctcccctgagaagctgagataaagggggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaa

SEQ ID NO: 10747 - DNA, 705 bp, Homo sapiens
  ENST00000470850
ccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtaggcagcggccacctcccgccacagcttgctttatgtcagttgaacgccttattactgaagctcatggaagtcccctcttcagacactccgtcaaataccccaaaccctcttctgcagatgtcctcactgttatcttttctcttccctccctaccccttggaatcacccctcagatgactacaggttcttctacctagttcagcacccccacaactcaaaaggtagaaaaaactctattcccaagttcctccaggagaggaggagaccaacttttttttcctctcatacccccaaaatacagatgccttaaaaatgagcctgtggttgggcacagtggctcacacctgtaatcctggcactctagg

SEQ ID NO: 10748 - DNA, 351 bp, Homo sapiens
  ENST00000478969
tgccatgctcctgggagctgattcagtctgtggtaccacccacatcctcacctaggcagcaccaaccctatgttctcttgctgtatgttctcttgtcccattttcaacagtactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagca

SEQ ID NO: 10749 - DNA, 501 bp, Homo sapiens
  ENST00000465697
ttcctttctccacagatcctttagttgctttagttgagctgctcctctagcagcagctccagcccaggcagctccttggggccaagcccttttccaagggtcagaagctgtgggcagggccaggctgaggcctctcctgatcctgtccccctgtccctggacctcactcccacaggccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctga

SEQ ID NO: 10750 - DNA, 1856 bp, Homo sapiens
  ENST00000479768
agtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatggaggcttttgaaaccccaggatgatgcctcctagaggccttgctgtcaaattcaataggcaataacatgaaggatttactcagccaggctcatgagaccagctctgaggaagctgtgcttttcttgtactgatcggtgatgtgcatcaccctaagggatagtaaacagatgaaacccagaaagtccagtcaaaagagcaccctctgggaatgaagatctagtgaagactggggagacagatgaggaaagagtcctgaacaggagccactcattccagctttgtctccatagcctgcccgcccacgatggatgaagtgcgtggaggagacaggcacgttcttcgagcccacgctggcggctttgtttgttcgtgaggcctttggcccgagcacccgaagtgctgtatgtgagagctcttcccagcccacatccctccaccccttcctacccaaagcagccttccctcttctattaactttgactttctcagtggtgtgtgtgattggggaattgggcagtcagagaagggccactg

SEQ ID NO: 10751 - DNA, 417 bp, Homo sapiens
  ENST00000494148
ggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttg

SEQ ID NO: 10752 - DNA, 649 bp, Homo sapiens
  ENST00000476829
gaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagatctttcgggaatacctgacttacctgaa

SEQ ID NO: 10753 - DNA, 786 bp, Homo sapiens
  ENST00000467543
agaagtgccccttctccaggatcaaggaactggggcggggggtgtttcctggaccccagtcctccgaatcagctcctagagtggaaccaggaaggattctggagccacagaagatagacagatggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatc

SEQ ID NO: 10754 - DNA, 556 bp, Homo sapiens
  ENST00000460479
gcaaaagtcctgcccccactggaggggagggaatgaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggag

SEQ ID NO: 10755 - DNA, 2812 bp, Homo sapiens; identical to SEQ ID NO: 10746
  ENST00000615381

SEQ ID NO: 10756 - DNA, 705 bp, Homo sapiens; identical to SEQ ID NO: 10747
  ENST00000633816

SEQ ID NO: 10757 - DNA, 351 bp, Homo sapiens; identical to SEQ ID NO: 10748
  ENST00000633860

SEQ ID NO: 10758 - DNA, 501 bp, Homo sapiens; identical to SEQ ID NO: 10749
  ENST00000633614

SEQ ID NO: 10759 - DNA, 1856 bp, Homo sapiens; identical to SEQ ID NO: 10750
  ENST00000633778

SEQ ID NO: 10760 - DNA, 417 bp, Homo sapiens; identical to SEQ ID NO: 10751
  ENST00000634110

SEQ ID NO: 10761 - DNA, 649 bp, Homo sapiens; identical to SEQ ID NO: 10752
  ENST00000633704

SEQ ID NO: 10762 - DNA, 786 bp, Homo sapiens; identical to SEQ ID NO: 10753
  ENST00000632261

SEQ ID NO: 10763 - DNA, 556 bp, Homo sapiens; identical to SEQ ID NO: 10754
  ENST00000631527

SEQ ID NO: 10764 - DNA, 734 bp, Homo sapiens
  ENST00000522578
tgtacaacttattttaaaaatggtataaaattaaatgtaccattatatactcaccatagatttaaatgctgtttaaagagtccaaatggtatcgagctgcttgagtggcacgttaaactacgcaaaaccaaatcttgtttaaaaactggttttaaaataactactggattttctgaaaaagatgtgatcagttttcatcttgttgagcgttttttcactagtgcaactttggattttttatgagaattttggtaccttaatgaacacctcgctccatgctggaagcactaagcacaaagcttttaaagactttctggcttgactaattgaggtcgcactcgccaaggctgaggatgtgtaacccttaaacggtcttcattttcaaaggaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctacttt

SEQ ID NO: 10765 - DNA, 793 bp, Homo sapiens
  ENST00000521461
ataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctactttaaacctagaaaaacaaagtcttgttatttcagcacagctctaaattgtatacacttgaaaaccatgtacagctgcaactcactgcaagaagtcaagattctacacatattccacatttgaaaatgatttatccatctcagttatggactaataaatatgaaagtattatgcaaaaagtattctgtcacataaaaggttaattataaagg

SEQ ID NO: 10766 - DNA, 197 bp, Homo sapiens
  ENST00000518728
actatgatgatggatatggcactgcttatgatgaacagagttatgattcctatgataacagctatagcaccccagcccaaagtaatttttttctatgaacaatccctttttaaataaatcagaatgcttaaaatctgaatggatggaacttaaaactactttgttgaaacatcaacctgggcagaaaaaaaaaaaaa

SEQ ID NO: 10767 - DNA, 396 bp, Homo sapiens
  ENST00000522433
gtcaatctgttatttggatccacaagtatacatcttatttaaggtacttatcttagagtaatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaga

SEQ ID NO: 10768 - DNA, 712 bp, Homo sapiens
  ENST00000522079
tgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaaggaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatt

SEQ ID NO: 10769 - DNA, 585 bp, Homo sapiens
  ENST00000524282
gtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatggcaagaagagtggactaactcaagacacaaggc

SEQ ID NO: 10770 - DNA, 1066 bp, Homo sapiens
  ENST00000517859
tttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatattggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtt

SEQ ID NO: 10771 - DNA, 5466 bp, Homo sapiens
  ENST00000519600
cagggctgctcaggtaaaattcaacattgtcaccgtgcttaacactttatctgatattttattcttcataatgaccctgaaatgtaatgacttttataagccacacctggtaaatgtgaaactgaaaactagaaatgctgagaaacctctgtgttcacattgctgataagatgagggcactgtatgatgacaccccttcagaacccatagcaagtgggacatcaggaggtgttatgggactaatggcaaagaagacaactatgccgctttcgttgtttattatttatatcatccagaaagtccaaaatacatactcagtccatctattagttaggccttttcttgttgcgaataccgactatgactagcttgaaggattttttctttaaaaaaaggaaaacaacaaaaaacaacaacaaaaaaaacctaccttagggtgtcctatagaatgcatggaggaattgaacttgcaaactgaaaagacagtaataagagctttaagcctaagaaattgtctctggcttttccctctagcagtattttttacctgggccacaattgacattttaaacaggacactttggtgaagggcaggaccatctgtttctgatgcctgacataggcctttgcccctgagtcccagtagtgaccctagtcattgtgacaaccaaataaacatgctaaatatttccaagtgtcccacagggaggtgatgcaacatctgcagtttgagaacctgccggagcagccaagcacattaccattattgtgactcagctctcaggacattcagtatccacataatcagttctaaatttcagaatctcttgatttccagtcaaaggccaattcctcggccgatctgggtggcctgggccaggtcatgccattttcagtgtggtggctcccttggtagccttctcccacttgccataggttctgaaggggatgcagttccacagtaggtgggtcttgttcagataaaattgtatatatccacaacagttaaattcatctatttattacttactaatttggcatcaagtatacgcaatctgctggctgctctcttaggtgattttcgtatactttcttacttaattcatgcgacctgcacccacagtaggtaatatggtctgtgttttgtggatgaaaagtctgagactcaggagggttaatttgactcaggagatagaagtaacttgactagggagatacatggttgaacagagttgagaggaaaaagaagggaaaataaaagtgtttctggttgtcacagtattcatttatgtactttttgtgaacaaaacactaacagaagttaagtggaaaaaagaaacccctaaaggtatataaaagtcaataaaatgctttttctttttacctggaatgctgtcaagtgacctttaatcaatcatgtctttctatggacttcagattcttctgtataaaattagatgtttggattggatgatttctaaagcctcttaatttttatcacttgggaactatttgacctaacttaagatgcaagataaatatgactatttgactatcaaaatttatttttgctccatttttgaaacctattaaaataaatataaatgaaataaaaaggcataaatttatgaagatcacaagaatgggagagtgggacaacaataggcaaatgatgtctgtaaaattttggtgcttgcaaaataaatagataaatggtaacggagaccagagaaagcagaaccctgagctggcaggcagggaagaattcaaccagaaacatgttcattactgtgggaaaactcgagagcgctcaggaattgtaggtagcaattactgtaaaggtggatttatggattagaactgacaagagtagacttggttgaaaggtataaggagtagttagatcacaagatgttctcatcttataaaaccaggcatctgcccctccacactctagcaaaagaccagaggtttcctgaagaggttgaattggacaactgtgaggctccaagatacagacagatacaactgaggatgagggtgagatatcacactgaaaatgagggaattgtttcctttaaataaaagtgtgcgtgcttagtgatgggattcccagtattctggcagctgggcttacacctcctcttaagagattgaggagtttctcttcagggaagtgcctcgcccaagtgaaacgaaatacagatactgatatttcagtagctcttgataaaataactcagctgccatatttgcaatgaagactgctgttgccaagtcccatgtatgaaaacagaacttccagtcagcaatccggaatttttaagaacagatagtagaggattaccagacatctgaggaaatcccataaaagagaaagagaccagctcacaaaatggggaaggggagactcttggaagaagcagatactttaaactccaaggcggggacaggctgctgtcatcaatatcttcagaaaggatgagaaatttaattgtttccacaaagtgtaacaaaacaccataaagaagaaacagctgtaagacagtcgtattcgtaaatatttgatagcaaaaatgaaggaatcagtaggtatataggaaatgtatttaaattctccagaaagtaaaacagagagacacaaacaataaaagagaaatttagagatagcagtccatctcaggatgtccaatgtccaaataataggattttcagaaagataataaaagtaaatggggagctagaatcaggtgggattgtatgggtcagtacccagtcccattcttgctccccatttactccactttttcactctgtagtagtattagactttgtaaactctgcaagtataacttttatgtttaaaaatattttactgaaaatggcattttaacaagcaaaaaataattacatgcaaagattaaaaatatatatttgagttttggttgaagaccaataaaattaaaagttggaaggaaaaaataccacttagattttttaaagtgctaagtacttatttcaggaaaattacttcaattgccatagttaggtaaattgaggaacaattttctctcagaaacagcagcacagcagtggcatggatcacggaagaagtggctgctatgtgagtttgtaatcaagcatcttgccaaggcgaacagcttcctccctgctgattttctatttggtagcaagaagtagtcatgatttaccttaattatagcaaggcttttaaaaattgtgtgaaattcctgatttttttttgtattcaagatgtatgtattgagtgtctgttatctggcaagcattgttttaaacagtttatttatattgacttatttaatccttagaacagccctatgaaggtaggtcttgttgtcattcctattttacagatgaagaaactgaggtatagacaggttaggtaacttgcccaggtttactcagctggcaaacagaaaaggctaggttttaaatcatggtagtctggttacagaaggcatacccttaattaattcattactattctgcttgttaaggaaccacagacatctaagtttaaataaattgcccacattcccatagctagttattttagaagcaatgaattttattgtaaagcttccatcagccaccgaatgcttaagaactcatctaagccagtcctctcattgattgaataactagatccaagggctgaccgggtagaagaaccaggtattccacagtgaccagtctagtgcatgttagagacacctggtgtcattttttctcacctacattctcatcctagaagtgttcattcatggtgatatttaacgtgtgctgaaactgttaggatagcaaccgaggaattctgggaaattagcttcattcacagttgtggaatatagccatcactgaaataaatataaagaaatatatcagggttttttattttacgtttagccccgttttatgtggtgtgtgggaaacatcatattttaatgcatgtagcaggagcttaaatatttgccattaatcaatgatgtgtagcacactacagtgtttcttaacattcaagattaagaaattgctttcacatataaatgctacaaatttggttgtttatttttcctagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgttagtaccatttttcttgatagttaacttgtactttaaagtctttgctttaatccttgatacttcttgtctgtaactgttatttgcatagctccttttctgctgtaaagctgtatggacatcacctcaagtagaccttacattgtccttgtaaattactgggcattattccttatgtatatatgaggtgttagaatttcaggaagatttaataatatggccaaggttacatggctaaaaaacttgcatagcacaatcactagttcaggttttgaaacgcttttcctacgattttatgtgacactgtacaacttttttgttctccaacacaaaaccattagtgcctctgtgtgccatgcacagtgcttggtgttggcatgcagacttgaataaaagcagtccctgccctcatttagtataatataatacgtaatttagaggaaaagagaaacatcaacagatgatttcagtacaacatgataaatataacagacataaccataatgagcccagaggggatgggctatttagctagcttctgccaagtattttggatgttttgttaaaaattgactgtctgttttaaccctttcagacaccttcacattgctaaggatgtgacaatttaaagggaatacatctctacctctgttacgaaagttgatttaagtcttttgtgtgatttgtatgctcttgataaaaggacttattatgtcatttgcatgctcttgataaaaagaatcgtaaagcatcaacactttggctctgcagacaatttattttagagaagctgacacatctgccaagtagttctctggataagactgtctttggttatcccaggttagtttggtggattgacttacatactacagcacatgtactgtgattatattatctgtgaggaaaacaattattatatttatagggaaaggatatttaaatcacttttgcctttaaaaagccaggacatagaattgcattaagtatgtaataacctgggaactgaaatggctagtattttctttagttcccatgagcaaatatgacaatctatttcttcttttagtttaaaaacaaaa

SEQ ID NO: 10772 - DNA, 679 bp, Homo sapiens
  ENST00000517394
attggtggctggcttgaggttcggaatagtggtgaagggagtccttgccattttcacacgactccagccagctcagggtgtgaaagatcctaggaagtactgcgggtcagggatacagagatttctggaggcacgcctacccgggacagtgttcccctggctttttcctcctgtggcttcctgaatcatctgctggcatgcacgaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagg

SEQ ID NO: 10773 - DNA, 1243 bp, Homo sapiens
  ENST00000520981
cctgtgtccaggctccaacagccctggcggggcagtcagccctcccaggggatgggcagcccatgccaagccttgcaggctggcccttggagaagtcagtaggggagaagaggccggcaaaagagcaccgttccggagggcgttgggttgggtgaccctcattggtggctggcttgaggttcggaatagtggtgaagggagtccttgccattttcacacgactccagccagctcagggtgtgaaagatcctaggaagtactgcgggtcagggatacagagatttctggaggcacgcctacccgggacagtgttcccctggctttttcctcctgtggcttcctgaatcatctgctggcatgcacgaaatagaaaagtttcaaaaaggagaaggcaaggatgaagaaaagtacatcgatgtggtgattaataagaacatgaagctgggacagaaagtgttaattcccgtaaaacagttccctaaggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaa

SEQ ID NO: 10774 - DNA, 889 bp, Homo sapiens
  ENST00000524199
ggtcgtttgcacggggacctgggaggctgtgggacacctaggggaagaccctgatgtgaattttggggacttggaaggagaaggctggggcgcatggaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccc

SEQ ID NO: 10775 - DNA, 1977 bp, Homo sapiens
  ENST00000355849
gagtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcagaatgcttaaaatctgaatggatggaacttaaaactactttgttgaaacatcaacctgggcagaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaa

SEQ ID NO: 10776 - DNA, 4153 bp, Homo sapiens
  ENST00000297063
tcgcccagaggttgacagaggaaggtgggtgggggcctagagcggtgggtcatggctggctgcacccgcaaactcactcacctccgtaaacggatccatcgccccaggcgtcggactacgagacgatggaaacggtggttcaaattcaggaagagaaaaggagagaaaaggccaagacctaatcataaggcagtggcaagaagagctaaactcaagttctctacctcagaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctcaga

SEQ ID NO: 10777 - DNA, 4132 bp, Homo sapiens
  ENST00000338533
gagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaaggttctca

SEQ ID NO: 10778 - DNA, 4241 bp, Homo sapiens
  ENST00000317020
agtttcctagcaaccggcggagcggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgtccggttatctcttaactatgttttcatttgctgaaacatattgtacccttttaaattttttacagagttttaacgtcttttccactgcatcctttataaaaataagtacaaattccagagaggttttcctacacaaatacaaaataattggggaagggctactcaccttttttatgaaacagaatatgtaacaagcagaggacaaatagactgacctggttaaacgtaggttctggatgttgatgggtagcacctgcagtaaacttgaccatgctctgaaaaaagaaatttctgggtattgatggtttataaagccagctttgtgctattggttcagtatattttatcaaatctttgacttcatcaacccagtaatgacatagtttaaattttaaaatgagagttctgttttgctgtatttctcctgctagcctagctttgtattttatcatcagcttcagtatatacttgtatatatatacctggattcaaatggttcttcatacaacttaatgatcagaaagaatgctgctgtaaacaccccactcaagattgctgctggaatttctacccaaagctgtctgagagtttatctttacctcagtgcaggcttaaataatggtgctaatactggtagatatatactgtgaagcctggttcacattcatgctagaaaatgattttgggaaatcttttataggagaggttacatgatttttctctttcacatatctagaaggacttgcctcaaagaagaatgttgcagcaaacaggatatactctagctggtgcccaaaggttcttgcaaaaccatgaatcttgcttttagcagtaaagggccagacactttggagcattgaaaggccttagcccctgctccccaactacgtgccatgctgggtagtgtgtatcctgtacatctgtgtgccaggctggggcagactgtgccaatgctcaccgaacactagaatctgctcttacacctctagcatgtatctcgttgtagcagagttgtgcactttctcagcattgtgtagtgttttctaattgcatctaaaaacttatcaaaagtgattgtgaaaacagtgtcttagaagtataaacagaaatggcaatatttatgtcctgtgattcaagcccaaaggttataaattcaactttcacagggaatagcactgctaatcttactttatgatttaaatataaaggaaaatcacagcagccttaatttcctgttggtcggatcatttgcagcagttctagttcctgacttttaaaatggatgaaattttctctttgtctgatttggaaaaggaactgcttttttgccttactgctttggtataaggatgaaaaacatgagcactctgcagacaaaatgaccttaaatcacattgattaagatattttaaaagttagcagtgaaccaaaagtagtttcagattagcagaaataaagagctttaagttttaaaagttgagattgaatatttaatgaaagtttattaattctttttccaggaatagcagtaaggtcagtttttttccctaaaataaaaagttttaataaacagaaaattatagcaacagtacttaggagaatagttgaagattgtattaattttaattataatagttatttgtcataggctattgatgattagaatttcattagttttgtccactataattttaaaaatagttgtgtcaaatacaaattctggtaaactgttaggttttaacaccagacagtattcaaaggaaattaatgtttgcaaacataaatccatagtcttcatttctttatattgtcacctttgtaaaagtgtttaaaatttgtattgtttgttttgtatatctttgggcatcttgtgtctagctataataaaaagaaacggtgccaag

SEQ ID NO: 10779 - DNA, 2441 bp, Homo sapiens
  ENST00000440378
aggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttgaagactcttggtcaaattgcatgataaatttctgcctgagcagtaagcactggcctagtgcttctgcctaaatatggaggtcagctccaactggagactggctgaattccattgctgttcagactccaaagttatattttatttgataaataatggtaattattctcctttgaaaaattagttttgtgttgctccaaaaagctagctatatatctcagctttcttatttcttttatatgttgagggattttaaagggagaggaaaagcaatttgaaaatttttcattaagtgttttattttaacattattgtttcaccttatcagcttataggaactaaattagagaatcacctctttttgt

SEQ ID NO: 10780 - DNA, 1952 bp, Homo sapiens
  ENST00000436884
aagcgcagcgcgcgcggaccccgggggcagtttcctagcaaccggcggagcggctacgtcacggtggcaggttctaagcgctgctgggcaccgtaaggccgccgtgtgtaccttccagtagctacgggctggtggaagcgctgctcacagtcagtgtcgaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcagtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagttaggtgcagttagcaccagaagatttataaaagaagaaagactacttgtgttttctgaagaagggtcttcagtattcagcggaatttttaggttaagtacagatcttaaactatttccctaaaatgtttctataggttgcagggggaagttattcctattttctgaatctcgacagagtcagatgaaaatactactgctgagcatttttg

SEQ ID NO: 10781 - DNA, 956 bp, Homo sapiens
  ENST00000453212
ccgccgtgtgtaccttccagtagctacgggctggtggaagcgctgctcacagtcagtgtcgtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagggtgttttagtaaagaccaggtatacttggatggaattcttcaaatcctccgatacagagataccatagacttccatctgctgactgctctcgggaaggtttcttatgaagatgtggatcgcttaaaaggattggcagttaccgaaaacatgagggtccctcatttcctgcaggaccatggccgatatatggaacacttagagaagatcatggaagtgaatgaactgactgacagggaactgaaagatcttatatagtaattagcgttctggcaaacatagctaagctatgcctccatgtatattaccagtt

SEQ ID NO: 10782 - DNA, 560 bp, Homo sapiens
  ENST00000483360
aaccggcggagcggctacgtcacggtggcaggttctaagcgctgctgggcaccgtaaggccgccgtgtgtaccttccagtagctacgggctggtggaagcgctgctcacagtcagtgtcgattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccagg

SEQ ID NO: 10783 - DNA, 741 bp, Homo sapiens
  ENST00000480192
attctcagggtgtgacggtcctgatattcaactttcttttgttcctgagtttgaaaacacaccccaattatttccatgtcttagccttgaggatgaagagaaaatttaactgtctgaagactgacagttgccagcactatctcagctcctcctaaacttctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcacagtgttctgtttagaaaagacccttttttatggagggctgccctcctctactacactgtttatcaagccagccaaatgtctttttgtgaactctttaaagatattggcaggtttgtcaaggaccccaatacaagatgggattattgtgtacgggccaagaggggatggactgatacttcccaaccag

SEQ ID NO: 10784 - DNA, 578 bp, Homo sapiens
  ENST00000483526
agtttcctagcaaccggcggagcggctacgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaacaacctccagcagccatggaacagttggactggacgtaaaaaacatgagctaaagccaaataatcccacagaggaaggactagcaagcattcac

SEQ ID NO: 10785 - DNA, 603 bp, Homo sapiens
  ENST00000431396
acgtcacggtggcaggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggtctatcaatattatggaactgactttacagaaatatggaagttatgaaaaatttgaacaagccactggtggtagcttgctctctaaaactcgaatctggagtcacgttaggaagtacatgatgaaggaaggctgcctaggggagattgtagttcatctcactgaggacctgctttcccgagcgtcaatgacagtagtaaatggatgtccgactctgactatcaatgtgtccactgcacgtgagcattggctggagggaatgctgaggcatgaaataggtacacattattttcgaggtattaaca

SEQ ID NO: 10786 - DNA, 2865 bp, Homo sapiens
  ENST00000415803
ggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacgggtgagtgccgggaagggctggccgcggcgggggtgcggggcggaccggggtcccgccgcccggggctcaggtaatggtagccaccggctgggcgcgccgctcgggactccaccctgcgccccgaccccttcggggcgcgcaggaggcgctcgcgaaaaacctgtggagggaagagagaaatcggccccttatcctttcgtcacttattatcaaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcaggtaaaatgccatttcaatagtggtagttcatttttatgtactaaaacaattatctgtgatcttataagcaaaaacaaagacatttaaaaatattcaaattatttctatgttatggttaattcccactcaggacatgtaaatgtgcgacaagacgagtattacctgtatataaactccattgcattcatcaaaatttataatctgttatataggctctttgtgacaggaagcaattatattaggaagacagcttcagattctggttctaagctttcatgtgggagttacaaacttgtggccaatttagccgcctacagacaagtgttgggtagcccacactacgtttttgttttctaattgatttctttgttgttttttgtttttttctgagacagattcttgctctttgcccaggttggagtgtagtggcacgatcttggctcactgcaacctctgccttctgggttcaagtgattcttgtgtctcagcctcccgagtagctgggactacaggcacccgccaccatacccagctaatttttgtaattttagtgaagatggggtttcaccattttggccaggctggtcttgaactcctgatctccagtgatttgcccgccttggcctcccaaagtgttgaggttgcaggtgtgagccaccatgcctggcctctaattgattttttaatgtcttagatggagcatgcaatccctggttcttcctattgtgttaaattcctggcttgcttaggctccggtaagtagtttgggaaccgaagcttgattcttgtccatgaacttgttaatgcttcactgaaattgttaatcatcatcaaataaatatttaagcacttattcaaagataaaaataatgggattttcaaaattatcttcaagtttagcaaattatgatgtgaacgttatgaataatacttttaaattgctcactttaagcccttagcagttttgtgttttacagggctataatacatttcagaacctcatttaagcatttgagaagaaattagctaatgtttatctgcagggcatagttttgagatcataaaggccgacaatatttggtcaaattaactttgttcaggtttttataatatattagcttcaacttggcattgtcagtgactgaaaatctgtttgtaggataggtaaaactgcatggttctctcgcctgtggtgcatgtcctattttagcatttttgctgataatagttatttggtcttgcggccagcagatattttgctgtttattatagataacatggaatctggccagtcttttgaagccattatgtaaaacttaattatgtaaagccattatgtaaagattaaaataattttaatcatggtatttactttcctttgttagggtctctttgcttctgcttctgtattctttaatgggtatttgctttttaaaaaatgtgctgagattgtgctaaaaattgtgattcaaattgataacttactaatataaagtggcacttctggatgggagaaggcagcattaacatagtgattacataatccactcttaggctgtactacttccacattgtaaaatggagtaaagaaaatacctactttaggagattattttgataattaaatgagagaatgcttagtgcatatattgcagttatcatcgtgcttggcacctacaaagcactaataaagaggttagctgtta

SEQ ID NO: 10787 - DNA, 1509 bp, Homo sapiens
  ENST00000493327
aggttctaagcgctgctgggcaccgtaaggccgccgtgtgtaccttccagtagctacgggctggtggaagcgctgctcacagtcagtgtcggtacgtcttcgtccgcccttaccctccttatcctgctccaggtagcggagagccgcctcccgccgcgcccccgccaccgaggcccgggtcagaggctagaggccgcccgcccctgcgcggccctttcccctgagcccgcggagcccgccgccccgggcctcggggcgacgatgctggagtccattcgcgtgacggaaaagcttcactggcctgagcaagaacttgctaagaagtctattctaaatgcagaagattcattgatcattgacaacaaaagaagcatttcacatttgtcctcgggagtgctaaaagacattttcacaactggaaccagtagttacaatgtcctactacagagcaaggaggaaaaaaagtatcattcacaaaaacagtcttcctccacctactccaaaagatgtagaaaacccagcaaatctcctaacacttctcgtagcaaagatcctcgcaggatgaaagccctggtgcctgtgacaagcagtggtacttggtactgcctggagaggcggcctgctgtttttgtcactagttcagtgtcaagtcctgtaaagtttacacatgatatctctgttacagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgtattagctaagcatagccacgcatctgaccgatttcttaagcaggtaaaatgccatttcaatagtggtagttcatttttatgtactaaaacaattatctgtgatcttataagcaaaaacaaagacatttaaaaatattcaaattatttctatgttatggttaattcccactcaggacatgtaaatgtgcgacaagacgagtattacctgtatataaactccattgcattcatcaaaatttataatctgttatataggctctttgtgacaggaagcaattatattaggaagacagcttcagattctggttctaagctttcatgtgggagttacaaacttgtggccaatttagccgcctacagacaagtgttgggtagcccacactacgtttttgttttctaattgatttctttgttgttttttgtttttttctgagacagattcttgctctttgcccaggttggagtgtagtggcacgatcttggctcactgcaacctctgccttctgggttcaagtgattcttgtgtctcagcctcccgagtagctgggactacaggcacccgccaccatacccagct

SEQ ID NO: 10788 - DNA, 437 bp, Homo sapiens
  ENST00000429651
gagcggtgggtcatggctggctgcacccgcaaactcactcacctccgtaaacggatccatcgccccaggcgtcggactacgagacgatggaaacggtggttcaaattcaggaagagaaaaggagagaaaaggccaagacctaatcataaggcagtggcaagaagagctaaactcaagttctctacctcagggaatggcatagtactgccacctaaacccaaaagcaaggtcaagtggtgccatttctccactcttccaaagccaaagcctcagctgtctagaagctttgaaaagggagatgacttttctgggaagaaattttgtatattgactgctataaaacccaccaacttagagaaagaaaaactgagattcttcaaatctgactatacctacaatcctcagtttgagtatgccaatcctgctctgccaagcgt

SEQ ID NO: 10789 - DNA, 512 bp, Homo sapiens
  ENST00000562514
agtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaa

SEQ ID NO: 10790 - DNA, 2824 bp, Homo sapiens
  ENST00000561679
agctgagtgaggacctgctgtcccaggcagtgatgatggtggagaacagccggcccacattggcgatcaacctgaccggagcccgccagtactggttggagggcatgctgcggcatgagataggtcagggtgtgggtatccgggcagatgggtaggcatgaaaggggcctgggagctgggaggggtgggaaggaggggccccaataactcccctttttgtttctcccccttccctcctgaggtcggggctttcccttcctgagcagccacctcccgccctctgcttacagaggtaggccagaacatgcctgcccatgctctgggctcgctctcatctcttggtcctttcgggtatatttttctctctccacttcctctccgacttctcccaacagtgcgggcaaggctggtcaggccctgaccggccagagaaagaaccctcagggtcccaccaggccagccaccacgctggccctccagggtggatggaaggccaggtcctgggaatggacttgacttgaggacacatggcacctggtttaggaggggactggccagtttgggcaggggggtgcagggcactaaccactattcctatctgtctgtccctcttcctcgagaatcctgttgctctgggcaagagtgatttttaccgggggcatcagcatgactgttcaagatgatatgggcacccaggatgttgggcagggtggtatatgtattcttgtgcccaggagggctgggggcaatgtcagtttgggagagttcgtgcacgtgtgtgggtgcgtgggtgtagggtggggggcggatgggtgggagaggattcatgtatgtgagcctctgtggatccttgggtgcgagtccacaggaggaggagcttcacgctgcctggggctgggagagcctgtgtgcgagcctgagttcaggagcatgaggatggaagtgtcgcggccagagccccggccagatggaacagggccagggctgggctcgcaggcgggtccccgaacgccccgcccagcgccgcctcccctcgccttccccgcaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 10791 - DNA, 1977 bp, Homo sapiens
  ENST00000568563
ctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 10792 - DNA, 3500 bp, Homo sapiens
  ENST00000561621
gcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagatggagaagtaacagcatgtgtttatcctgatggaaagagtccagtagagaggaagagattgatgatgtaggagagaggagaaatgctggaagtgagtcactgagcaggcaagggagctcagcagctggagcctctccagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 10793 - DNA, 3550 bp, Homo sapiens
  ENST00000290881
tggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagatggagaagtaacagcatgtgtttatcctgatggaaagagtccagtagagaggaagagattgatgatgtaggagagaggagaaatgctggaaaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 10794 - DNA, 798 bp, Homo sapiens
  ENST00000563918
cccccttccctcctgaggtcggggctttcccttcctgagcagccacctcccgccctctgcttacagaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgttt

SEQ ID NO: 10795 - DNA, 2233 bp, Homo sapiens
  ENST00000563902
cgccggctgggcgtccggtggccggtgtagcagagcgggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgc

SEQ ID NO: 10796 - DNA, 836 bp, Homo sapiens
  ENST00000563831
ctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagc

SEQ ID NO: 10797 - DNA, 680 bp, Homo sapiens
  ENST00000570009
gtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggtcagggtgtgggtatccgggcagatgggcacccactacctgcggggcgtgaacaacgcgcgccagccgtggcacaacgcggagggcc

SEQ ID NO: 10798 - DNA, 592 bp, Homo sapiens
  ENST00000564835
caggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggtcagggtgtgggtatccgggcagatgggtaggcatgaaaggggcctgggagctgggaggggtgggaaggaggggccccaataactcccctttttgtttctcccccttccctcctgaggtcggggctttcccttcctgagcagccacctcccgccctctgcttacagaggtaggccagaacatgcctgcccatgctctgggctcgctctcatctcttggtcctttcgggtatatttttctctctccacttcctctccgacttctcccaacagtgcgggcaaggctggtcaggccctgaccggccagagaaag

SEQ ID NO: 10799 - DNA, 439 bp, Homo sapiens
  ENST00000564423
tacgtcatcggcgacggctcccgccggctgggcgtccggtggccggtgtagcagagcgggagcggcgggcggcgagcagaggagctaacagtttgagtaccaggagcccatgcccacggctgtgctggaaaagtactgcgaggcctctggacagttcatccatcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagatag

SEQ ID NO: 10800 - DNA, 527 bp, Homo sapiens
  ENST00000568165
ggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggtgagcttgcctgcagagcccttcctctacatgccccaaatcagggtgtcttgtgggcggtcccaggtccagctccacacctgacccacccctgcccctgccccagtgaggtgggagctggttctgagcagaggtgatgaagggtgggtgccctggccaattgtctggcctcgctgccctgtggcatcattgggtccacctgcaccctggccccaggctggtggccatggctcagagcactgccacctgcaggttgtggtgcagctgagtgaggacctgctgtcccaggcagtgatgatggtggagaacagccggcccacattggcgatcaacc

SEQ ID NO: 10801 - DNA, 983 bp, Homo sapiens
  ENST00000447063
agtatttgagggaacatccgggctctggactagactttcaggatctaaggctgaatcctacacagtcctccctctgggaaagtgatgaaacctgtgagctctcctagcaactctgcagtcttccttcaagggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtgggactggaaaatatcttaaagtgaacagccaggtacataccgtgggctgtgactactgtgggccactggtagagattgcccggaatagaggatgtgaagccatgggacttgagcatccatggatttggtatccgagggcgtcctggaaccaaccccccacggatattgagggaccacagtatttttatcctccatgtcaccccatccctgacctccagaaacaaacaatcatttgccattttaaaggacctacactaaatgagcaacagaagagctctcccacccaccaccgactccatgcctgttttcagcattgtagggaggaagagtcccggccctggctgatggctctcagctcctgggatcaggtggcaatggagggtcatgtctcggcttcattgacttcttgcatcgtaaggctcctcttatgagacaacctttcctctcaggcccttaggtccaagtcccctctctcagctttctctgagacctca

SEQ ID NO: 10802 - DNA, 553 bp, Homo sapiens
  ENST00000525249
ttcagtattgtgtagtacagaaaagatcacacatgtatatgtcagaagtagatgcacatgttcttttggctttttttctttgttttattcttttttcattttttgtgttttttgttagtttgttttgaattttttttcttgatgcatatgttccttcaacttattcagtacttccatgtgcagggctctggactagactttcaggatctaaggctgaatcctacacagtcctccctctgggaaagtgatgaaacctgtgagctctcctagcaactctgcagtcttccttcaagttggtcagattggtccgtgtggaactcagaaacagaaggccaaccatgcataacgaggcagaacttttggagatccttggtgacctcactgttgctgaataaactttagcccctcacctggtgataacaccaataccacctggttttcttccagggcctgtgcttccttcagagactcacacaagaggtttatcatgagaaggaccgcactatttcatttcactcctacaagttttcatttacgttacacattgagaaag

SEQ ID NO: 10803 - DNA, 9587 bp, Homo sapiens
  ENST00000524591
agtattgtgtagtacagaaaagatcacacatgtatatgtcagaagtagatgcacatgttcttttggctttttttctttgttttattcttttttcattttttgtgttttttgttagtttgttttgaattttttttcttgatgcatatgttccttcaacttattcagtacttccatgtgcagggctctggactagactttcaggatctaaggctgaatcctacacagtcctccctctgggaaagtgatgaaacctgtgagctctcctagcaactctgcagtcttccttcaagggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcactttgagaagcaagacgtgcttgttccatggaacagggctctgtgttcccagctcttctcagagtccagccagtctgggaggaagaggcagtgtggatacccagaaagaggccatccctaccatcctccttgctctgagtgtagctgttctgtttgttttaaagagcagtgtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtttagactttgatcaccaagagccattttcaacaaaagggcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagttgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagagaggttgtgattgattggatccttttagacaactcctccaaaagatgaaccacattctttcctcttggtttgatatggttacctgaatttgcattcagtgttatttgttaatccatttacgctttggtctgcagagactattaattatttggttgttttgttttcatttttgaataagcacagattctggcattgaaagcacttgacaaagggtatttgtgcttaaatgttaatatacaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaacaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaaggatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcgttgttagcttgtaaggagtggagtatgtaggtagtaggagttatatgcaagtacccaagtggtattcttccaatcttattagaagcatgaatattcaagattgatattactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctctttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcaccgtgttagccaggatggtctcgatctcctgacgtcgtgatccacccgcctcggccccccacagtgctgggattacaggcgtgagccaccgcgcccggcctgttccttttatttcttaattcaggacactaaaccatgactgcaagggatttccttggtaaaaagaaaagattctcagagtcaaaatggtcttacaactcgggcttgacggcctttgaattatgaatggattgttcctctctctgaagcctattgtcacatgggtttttaatcctggccttgctgctagaaatctgtgcttgaagtcctctctttctgctgctagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactatctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtctaagaaaaacaaattagggcaggcctcagcatctctttcctattacatagaaaatctgaaatgagaatagctgtgaacttttctaaatatgcaacattcaactatcgcaaggacaaaaaaccaaacaccgcatgttctcactcataggtgggaattgaacaatgagaacacatggacacagtaaggggaacatcacacactgggacctgttgtgaccccgctgagggagttcctcttgccctctacccccggggcttgtatatagattataaatatataagggggaaaggggtgggggggaggggttgtgcggctggggcctcacttcccctccttccccttctcctggtcccctgtcccaggggctgtttgttaaaaaagagtaataaaggatttttgtttttaaaaaaagcaacgttcattaatttatatgcagtcctcaccacagccctccaagataactatacttattgttcccattttgcagatgaggaaaactgaggcagaaagaaattaaattgcttaaggttacacacatagtaggtatcacacatttagttagaggcagagctgggattcaaacccaggtctggctcctagtctctgctcttaaccacaacaccatatactcccacccctgggcccagctcatgtgcttggcggagtattagagcctttcaaggtaagtgtgattatcccctttccaaatgagctttggaaaagtttaagcaaagattacacagctagacaataattcaatagtagtctcttacatattttcccttttatctttttttcatttgtaaatctgtttcgatttgatttgaattaaaaaatagttcttggttgcaaaatattctgggaccacttttctccaactcttcaacctttcaacaattatattattgttttcccattttataagtaaggcaactgaggactattcagatatttcattcactccatttgtttactaagccctgctgtgtgctggatacacagtctgctgtgtgctggatacatatgatacaaggtaatgactatctggcatcttgaaggtacccagaatattagaattaactgacccacaggtgccaagctgaaacattcttcgtattccctgtgtgcctattaccaagttatattgtttagtttgaggaaaacaacaaacaaccctcccttagagaatcatgatgcatattagcatatttaaggagtaccctaaagcttggacttaatctagcttaccctagacgtattaacatcctatagcgcacgtgttctgtgggatatatttcagaaaataatatgtcttacagaataaatgcagactcctttggatggcattcaggcccttcataaagtaactctgaattatttttcagtctcatttcctgcagttgcacccgattttttctgttctgcaatctgctattttagacaaagctttcataagaaattacataatgacaagtaattcccacattccctagatatatacttggatttcaaatgccataattgtaatctttctccaaagaaaaatgcacgatacaggcttcattctatcaagaggcatatgaggtaagcgttattatacacccgtccagcagatgggaaaaccacggaagtgggagggaatcaagaagcattaacagaccctccaccaaccgtaatgcttaactcctcttgttccaatcttaactcaaaattatgattattttgattatttaatgattgttttgatagtataaactccatatctgcaacctcagttatctacaacactgaggtgcaaacatttaaaaagatctctcaccaaacaaggattgaaattgtattgcaaatgaaagagctcagcatgagagcacaatcagaaactgaagagagttgatcaaagagaagattctagctgaattgttctatttttaattccccagggatcctacggtctatgacacattaacaggggtgtgaatcatttcagttacatcacatactctgtcctcttgtggtgcgggtcttccccagttgattatacacagataatcaatgactttatttgggagggattggagctatagaataatctatcttaccaatctgatggaccatttgtaagagctgtttgtcaaattggatcttcatttgacaaataaatactagagctgcagaaagtaaagtttactccaacccaattaatcattaatacatccacaggaaaaatacattttctccacatggaatattgatttttctatgaatattacctccacattgaaaaacgagtgagtcactgcagttaagccagtgtaccttgatgttgaattccctgaagaaggtacaattatatttacattcccttagcaagaatttggctaagtgataagcacttttctcttttcttttctttttttttttttttttttgagacagtgtctcactctgtcacccaggctggagggcagtagtgcagtctcagctcattgcaacctctgcctcccaggtttaagcaattctcgtgcctcagcctcctgaatagctgggattacaggaacatgccaccactcctggctaatttttgtatttttttttaagtaaagacaaactttcaccatgttggccaggctggtcttgaactcctgacctcttacgagctaatcataccacttctaactagattttctattaatgtacaaggagggactccactactaaagtttgttttacttctctggttatttacacaaaacgctggcaatacattaaggctcactaatgtggacctaagtgagtatctgagaggctttgaatatgtatgtgcaaactgtcctattttctttatatgctctcttaaatatgtatgtctgtaaatatatatataacacacatatatatatattcctagacatctagtgtttgctgtcattagtgaccaagaaaaagtagttcttttgtgcacgcgtgaatacatcaaattagcaattaccatagaaatgtatttcattgaataaatagcttttgtttgtttgtttgtttgtttcagggaaatttagaacaattattagatgttatagtgcctcttctcgtgttgatacgtgtatttgggtcaaaagtgcaaaaacttttttctacaatgtacagttattttgacttttcccaggggaagctagcaatagttttaaaagcacaaagtgatgtaaaatattttgacttttataataatgcgaagtagttttatttgcattaatcaataatgttcaggatctttttgtagtaagtatattttaaatggtgtaatttgtgtgtttatgatatgtattcaattatttaagttaagtatcagtgtatttttaaaaagtgttcccaggtgaacaaaagtttgcttttcttcaccattctgtacaggacaagcattattcagttcacatagtcagctctcactacacttcaacagaacggggcaagttcgtatttgaattctgttatatttatctaagggaagcaaaattaaccttttaataatagattatctttaatggttattaaaagaatgttattgaccaaaaagacatattttgagattaataaagatgtattagattatccaaaa

SEQ ID NO: 10804 - DNA, 579 bp, Homo sapiens
  ENST00000528335
aaaaaattaagtgagaagagccgcgctaaagccaagcgtcgtcgtcacccaaggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagc

SEQ ID NO: 10805 - DNA, 1982 bp, Homo sapiens
  ENST00000400069
aaattaagtgagaagagccgcgctaaagccaagcgtcgtcgtcacccaaggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggtaaccaggcagcctcatcgctgacataggtaaccaggcagcctcatcgctgacataggtaaccaggcagcctcatcgctgacataggtaaccaggcagcctcattgctgtcataggtaacccagcactgggccgtgtagcatgaaataccttccattgagcctttgcttttcacattgatttttcatttttgttctaataggaatcctgaaattgcacccttggcatgccagtacctagaatattcattttacagcagaaactcgagacagtcaagtcagcagcaagtaaaaaactttctcaaacttttattttatttttattcttttgagatggagtttcactcttgtcaaccagattggagtgcagtggtgcaatctcagcttgctgcaaactccgcctcccaggttcaactgattctcctgcctcagactcccaaatagctatgattacaggcacccgccaccacgcccagctaatttttgtatttttagtagaaacggggttttgccatgttggccagactggtctcaaactcctgacctcagatgatccatctgtctcggcttcccaaagtgctgggattacaggcttgagccaccgtgcctggcctcaaactttacctttagacagtggctcttcagggcctttgtgtacatcctccaccaaaacggacctgacattgattgactaaatcaggatggaaatgatggcttgtgaaactaaccgttgtaaatttaaagatattcacatttgccaaatgtgttctcctctggtggctcactttgagtggctcacatgccttctatagaattgtgggattatggaagaggtccagtaatatcttatgaatctcatgggtcctttcctttaattattctataggtgtttcattataggagcgcatctttaattagacagtattttaataataacttatttgtctggaggacgttggttcagtatcttcgtaaatcaagaactggtaaaccacagcttagtagatctaggactaagacttaaaatgtggttggaatctcactcaaggcctacccacctaaaactgcgttctagcaattgcatgctgactgcacctatgagtcgtaagtctgtagttgcaaagtgtgtctagtttgatattctttctaaatactggtaagagaaacagacataccagaacttgtggcttgctgaagatggtatgagtaatgtggaatctggggaaggggtgcatgtcacatggaaattgggagtctttgaaaaatatctctatcctgtaaattaaaaaataataaatctagtttcggagtgtgc

SEQ ID NO: 10806 - DNA, 2392 bp, Homo sapiens
  ENST00000528753
aggcgccgcaggcctgggttcccggacagctgagcccgagcgccgcctcccgaaaggtgaaggcggcccggggaggcggggacggtgacgggggcgggggccgcgggcggtctcccgacggctgtcgcggggccagcccaaagcccccgatccccggtagctgcgcttcccgcgcggggcgccggagtagggcgggccaagctggcctgcggccgcggcgggaagaagggctagcgaagcacccccgaccgggcccaggcgccggacgccggggggcgcctcgctgcaacttctctttggaagccccgacacgagccccggcccgcgcgcgcgctcccccacggccacgcgcgcaccctgccgcccgcacccccgcgcgccctccgtctattttttcctcttcctttcatcctcacactctaaaataggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggtaattttcctgtaatcacaggatgactcaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggtaaccaggcagcctcatcgctgacataggtaaccaggcagcctcatcgctgacataggtaaccaggcagcctcatcgctgacataggtaaccaggcagcctcattgctgtcataggtaacccagcactgggccgtgtagcatgaaataccttccattgagcctttgcttttcacattgatttttcatttttgttctaataggaatcctgaaattgcacccttggcatgccagtacctagaatattcattttacagcagaaactcgagacagtcaagtcagcagcaagtaaaaaactttctcaaacttttattttatttttattcttttgagatggagtttcactcttgtcaaccagattggagtgcagtggtgcaatctcagcttgctgcaaactccgcctcccaggttcaactgattctcctgcctcagactcccaaatagctatgattacaggcacccgccaccacgcccagctaatttttgtatttttagtagaaacggggttttgccatgttggccagactggtctcaaactcctgacctcagatgatccatctgtctcggcttcccaaagtgctgggattacaggcttgagccaccgtgcctggcctcaaactttacctttagacagtggctcttcagggcctttgtgtacatcctccaccaaaacggacctgacattgattgactaaatcaggatggaaatgatggcttgtgaaactaaccgttgtaaatttaaagatattcacatttgccaaatgtgttctcctctggtggctcactttgagtggctcacatgccttctatagaattgtgggattatggaagaggtccagtaatatcttatgaatctcatgggtcctttcctttaattattctataggtgtttcattataggagcgcatctttaattagacagtattttaataataacttatttgtctggaggacgttggttcagtatcttcgtaaatcaagaactggtaaaccacagcttagtagatctaggactaagacttaaaatgtggttggaatctcactcaaggcctacccacctaaaactgcgttctagcaattgcatgctgactgcacctatgagtcgtaagtctgtagttgcaaagtgtgtctagtttgatattctttctaaatactggtaagagaaacagacataccagaacttgtggcttgctgaagatggtatgagtaatgtggaatctggggaaggggtgcatgtcacatggaaattgggagtctttgaaaaatatctctatcctgtaaattaaaaaataataaatctagtttcggagtgtgca

SEQ ID NO: 10807 - DNA, 668 bp, Homo sapiens
  ENST00000532376
ctattttttcctcttcctttcatcctcacactctaaaataggtcaaggggtggaagttacacctggtgcagccctcggctctgatgcaaaagcagcttttgcccctggctgcgggacagcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgcagggaggagggggcgcgacaggtcgtctagcgcgtgccccggagcccgcgcccgggtctggccgcctggggcctgtgcttccttcagagactcacacaagaggtttatcatgagaaggaccgcactatttcatttcactcctacaagttttcatttacgttacacattgagaaagttatgagaagcaactgtcactctctggaggtggagactgccgtgattcacaaagacaagaggatggatcatgaagccgcccagctggagaagcagcatgtgcacaatgtgtacgagagcacagccccttacttcagcgacctgcagagcaaagcctggcctcgtgtccgccagttcctgcaagagcagaagccaggcagcctcatcgctgacataggttgtggga

SEQ ID NO: 10808 - DNA, 2758 bp, Homo sapiens
  ENST00000529706
tttaaactattcaataaatagggtcatattttcattgcaaaatgaaagatgcattttaatgaaattgaagttaaagaagaaagaaatgaaaaagaaagaagttcaaagggatgaggagaagaaaagacagatggtaatatgactgtcctctaaaggaaatggtttctgttgctaggtttttccacttagctaaagtcatcagctgtttgatgaatagacaatagtttggattaaaaaatatttaaaattcttttattgttcacattcaagatttaaacatgaaggccattagaaatgaataggggcaaatcaagagttctagggcactggaagcatgtcaggagaaaagacctctgtttccttcttattacaaaatgctctctgaacaggccctcctcattctaaagatgtatgagtctgattttattaatatcattgaagtaactttccctttcatttctcctaaagtatccctcgagccaatgaaaaagcaaatgaattgcaaggttatttttcttaaaataggaccatcgtcttttgaaatacacaggattttaattttaaaatactttgtgaattatattttccccatgattgccttcaaacagagggtactttttctcataatcattattgggaacagtgtggctacgagatcaaagaaataatatcatagaaataatatggtcacatttacgtagaaataataatcctggaattgttttctttttcttttttgagacaaaatctaactctgtcatcacctaggctggagtgaggtgatgctaccccagctcactgcaacctccacctcctgaatttaagtgatttttttctgcctcagcctcctgagtaactgggattacaggtacctgccaccacacccagctaatttttgtatttttagtagagaggggtttcatcatgttggccagactggtctcgaactcctgccctcaagtgatccgcccaccacagcctcccaaagtgctaggattataggcatgagccaccgcgccagaccccaaattttattttttattcatatattctccactgtctcagctggcattaatgaatcttaagtttgcttttactgtatcataattttgaaagtgcctagtaaggaggggttattagtgtcctgatgtatttcagaagcagcaaactaatcatctttgaatagtggtagatatcttttcaggtagaaaaatttcatcagtaatgccaataagtacaaatataggctctaatgatttcttttaatatttctggaaagtaattagattatatatctgtgatagaatataatactaagtattagactgtagaaggctttgtttcaaggtggtttattcattcatgttactacctacctcaatcataacatcagtaagacctcaatgatctaaatatttgggctttgtaaatcctgaattacttaggtctctgctactggaaagtgaatatcaaaaattgtctatttaagaaaaaaagtagtttttataatctgagttgtatactggacccatagagatcattttaaatgtagcaatgaatagagattggataaaaacaatgttaaaaattcttttctaattcaagttcaaattttaaaaatttgaaaggcatgttttagtgtataaataatagaaaagttgttgacagttgtttgttttgcagtcagcaagtggtaagaatctttggagagacaacaggagaataaaagccgaaacatgcgtatatacaaaatgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccgtctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgaggatagcatgtaacgcaggtttttctcttataggttgtgggactggaaaatatcttaaagtgaacagccaggtacataccgtgggctgtgactactgtgggccactggtagagattgcccggaatagaggatgtgaagccatgtcatacatcatttttctacaaaacaaagaagaatcagagcaataaaagaaatggccagggtcttagttcccggaggccaactgatgatttacgtttgggcaatggaacaaaagaaccgtcactttgagaagcaagacgtgcttgttccatggaacagggctctgtgttcccagctcttctcagagtccagccagtctgggaggaagaggcagtgtggatacccaga

SEQ ID NO: 10809 - DNA, 6003 bp, Homo sapiens
  ENST00000529978
atgaaatatgaatgtgagcttagaggctacacgtggtctctcggatactagaactatctttcttgccttggaccagctaacgtgccttggttgcgccagtgtactgagccctgtggacatcacctcattaaatattcaataaatgttatttttttcctattgcctttctctcttctatatgagaatctgtaagtattcgccgaaggcttttcttttgcttttgtgaataccttcacaccatgttgtattctgtcttggttagttaaaaaaaaaaaaaaagttggccaggcacagtggcttgcacctgtaatcccagcactttgggaggccgaggcaggcggatcacctgaggttgggagttcgagaccaacctgaccaacatggagaaacccgtctctactaaaaatacaaaattatccggtcatggtggcacgcgcctatgatcccacctactcgggaggctaaggcaagagaattgcttgaacccgtgaggcagaggttgcagtgaaccgagattgcgccactgcactccagcctgggtgactgagggagactctgtctcaaaataaataaataaataaaaggttaattatatttcttgttatgagacaaatgaagtatttcacattttccattgaggatagcatgtaacgcaggtttttctcttataggttgtgggactggaaaatatcttaaagtgaacagccaggtacataccgtgggctgtgactactgtgggccactggtagagattgcccggaatagaggatgtgaagccatggtatgtgacaaccttaatctcccctttagggatgagggcttcgatgccatcatctccataggagtcatacatcatttttctacaaaacaaagaagaatcagagcaataaaagaaatggccagggtcttagttcccggaggccaactgatgatttacgtttgggcaatggaacaaaagaaccgtcactttgagaagcaagacgtgcttgttccatggaacagggctctgtgttcccagctcttctcagagtccagccagtctgggaggaagaggcagtgtggatacccagaaagaggccatccctaccatcctccttgctctgagtgtagctgttctgtttgttttaaagagcagtgtggttcaaaacggtcccacagcgtgggctatgaacctgctatggcaagaacctgttttgcaaatatttctaaggaaggcgaggaagaatatggattttacagcacattaggaaaatcgtttcgttcctggtttttctccagatctttggatgaatcgactctgaggaagcaaattgaaagagtaagacccttgaaaaacacagaagtttgggccagtagcactgtaacagtccagccttccagacactctagtttagactttgatcaccaagagccattttcaacaaaagggcaaagtttagatgaggaagtgtttgtggaatcttcttctggaaaacacttggagtggctgagagcaccaggcactctgaaacatttaaatggagaccatcaaggggaaatgaggagaaatggagggggaaattttctggatagcactaatactggtgtgaattgtgtggatgcaggcaacatagaagatgataatccttctgctagtaaaatattgagaaggatttctgcagttgattccacagatttcaacccagatgatacaatgtctgtcgaagatccacagactgatgttttggactccacagcctttatgcgctactaccatgtgtttcgagaaggggagctctgcagtctgctcaaggagaatgtgtcagagctccgtatcctgagttctgggaatgatcatggtaactggtgtatcattgcagagaaaaagagaggttgtgattgattggatccttttagacaactcctccaaaagatgaaccacattctttcctcttggtttgatatggttacctgaatttgcattcagtgttatttgttaatccatttacgctttggtctgcagagactattaattatttggttgttttgttttcatttttgaataagcacagattctggcattgaaagcacttgacaaagggtatttgtgcttaaatgttaatatacaagatctgaagaagcaacagaaagtacccttcagtacacctcagacttttttttaaccccagagagataaaatacatgtatagtgtttttcagtattacacattgatttaaaaagattatgctgttaaataatcttttaaaacggtatttttataaagtgaggggataatttctggttctcaggttataactgagagcagtgtgcaagataataggtaaatttgatccattgcacagatatactttgaaccatgtgatgagttatcttgttgccaaggccttgcttctacttaaagttttcagaaaactgagtgacagtggagagaaacaagaagttttacaaggactttactaaattataagcaaacttgcttcaaaataagttgacatgtgataataaggttttcaatgtagcccaggaggtttttaaaggcactgttaggctgagcatggtggctcatgcctgtaatcccagcactttgggaggccaaggcagaaggatcacttgaacccaggagttcaagaatagcctgggcaacatagcaagaccccatctctataaaaattagcaagatgtggtggtgcatgcctgtcatccaagctactcaagagactgaggcaggaggatcacgtgagcccaggaattcaaggctgcagtgaactatgattgcatcactgcactgcagcctgggcaacatagcaagactctgtctcaaaataataataataataataataaaggcgttgttagcttgtaaggagtggagtatgtaggtagtaggagttatatgcaagtacccaagtggtattcttccaatcttattagaagcatgaatattcaagattgatattactattgcttattagcaagattgttatcaatcatgcttattagaaggatgaatatccaagaccaagattgactaatgatgagtctgcatcaagaactaggcatttcttctgagttgacggactctttaggaaaggagaatctaagtgaagcactgattttagctctgagaacaaacaaattaaggtacagcatagttagccttggtagaggtatgacttggatttgctgtatcctttaaaatagtatctgggcatttattttattgaaggtgactacattttattagttatattaggaatttaggtagaatcaacttctactgattacaggttgaatttctgtcactttgtagagaaacgaatagactggacactgtgtggtcactgtttagatttgcccatgggtctctttaaatctatgtcatggatcctgagacacaaatataattaagacaggtctagagacaggagaagcagaaataagttgacccaggagtacagtctcaagtagttcattaatgagaaaattgacatctgacaagagtctttttactttatgctggatgaaaatccaaatcttgttttattttttccactaaaagtgactaaaataataacgaatttcatttgttcttgggttcttttttcctttaatgattgtgctataacttaaaataatgatgttacttttgaacaaacttaaagaaatatttttaaagcgtatctgaaaacgattgatgtttataactctcttttggcttcaaaataagattgtgttatcaccattttggtagatgaggttgtctggtgaaaatgatgcatatgagttgtactgttcagtgtacatcctgcagtagtggatgattgaaaacatatataagtggagtataaattaaaaattaatttggtttcttctatttcttttttttttttttttttttgagacagagtctcgctctgtcgcccaggctggagtgcactggcgcgatctcggctcactgtaagctccgcctcccgggttcacgccatcctcctgcctcagcctcccaagtagctgggactactggcacccaccacgacgcccggctgtttttttgtatttttaggagagacggggtttcaccgtgttagccaggatggtctcgatctcctgacgtcgtgatccacccgcctcggccccccacagtgctgggattacaggcgtgagccaccgcgcccggcctgttccttttatttcttaattcaggacactaaaccatgactgcaagggatttccttggtaaaaagaaaagattctcagagtcaaaatggtcttacaactcgggcttgacggcctttgaattatgaatggattgttcctctctctgaagcctattgtcacatgggtttttaatcctggccttgctgctagaaatctgtgcttgaagtcctctctttctgctgctagcctaccagttaaaagtcaagacttggtggaactcagtttaccagactctttagcctttgagctaaactgtctgagcaacctcttagatgtgcacacaccactttgtatgaaagggttctctagaacggttctttggagagaaatattttcatgtacgtttgacaggggtgtaaataaagcatgctgactaataagtcttttactcttcatctaatgaacataagaatctatgcatccagatattattttgtatacaaatatttaatttggtgattgataatctctctttggggtagtcacatggaaagctcttttaaatttaacttccgcctttggattttttttaaaaagccattgaagagcaaaactaatgtaaacgtcttgatcatttaaaaagcttgcttgtcctcgaaaggaaacacaggtcatcagtgagtataaacgtagacagttgatttgtgaatgctgtcggcctcaacttgcttgatgatagattctactgacctagctggagtaatctgatcacttacttccttattaatactagatcacacagtgtctttcttattccttcttctttacttactggcatcagcacagagtcccactatctgaaatagaagggagagtttgggggtttattggaggagtcttaaaaacttggttggcagctgggtacgatgactcacacctgtactcccagcacttcaggaagctgaggtgggtggatcagctgaggtcaggagtttgagaccagcctgaccaacatggtgaaaccccgtctttattaaatacaaaaaattagccaggttggtggcgcatgcctgtaatcccagctacttgggaggctgaggcaggagaatcgcttgaacctgggaggcggaggttgcagtgagccgagattgtgccattgcactccaacctgggcaacaagagtgaaactccatctccaacaaaacaaaactttgctggcttcctgatgcctcactgtctatttgaggaattccacagaatcttcaaaggatttgggggaaagcgcattaacatggacaaaggatggaatcaaaataatgttatagtgagaatcattcaagcacctatttaaattttttccaattgccagtatagtgatgatatgacaccagcatatcaaagtaactaacaaactagctacacaaacgtcttggagtttggtttcgttctcttttctcatcatagatctccgtgcagaatagtgctaattcttatttctcgtttgcctttctatttccttccaaattctacatgccagtaattcctctgtcttttaagtgaccatcaattcaataggcaaaaatttggagtaatccagagaaaaaaccatccaaatataaaccagctaggaacatgaatgcccctgattattaatggccaaaaaaaaagcactggtggattttaaattaaattaatacatatatacgagtttggaggagaacagaagttctaactcagtacttgaacttggtgggggagggcacaggttaaatatgagctgtgagcccccagttttggaggaaggaggaaatgggaaccaaccaccagacaagcagctgcagtct

SEQ ID NO: 10810 - DNA, 6751 bp, Homo sapiens
  ENST00000381176
aaggttggtggcaaccaggagccggggaagaggccagcagctgcagggagaccgcagccagcggagggggcttctgatccctcagtcacagggctcggcaggcagctctggacggatcaatgcaagccagacgatgaccagttgtggccagcagtccttgaacgtgctcgccgtcctcttctcattgctgttttctgcagtcttgtctgcacatttccgggtctgtgaaccatacacagaccacaaaggccgctaccactttggcttccactgcccccggctctcggacaacaagaccttcatcctctgttgtcaccataacaacacggtcttcaaatactgctgcaacgagacggagttccaggcggtgatgcaggcgaacctcacggccagctccgagggttacatgcacaacaattacaccgccttgttgggagtgtggatctatggatttttcgtgttgatgctgctggttctggaccttttgtattactcggcaatgaactacgacatctgcaaggtctacctggcacggtggggcatccaaggacgatggatgaaacaggacccccggcggtgggggaaccccgctcgggcccctcggccgggtcagcgggccccacagccgcagcctcccccaggcccgctgccacaagccccacaggccgtgcacacattgcggggagatgctcacagcccaccgctgatgaccttccagagttcgtctgcctgaaaacgcttttgctgtgcctcaggatgggggagatgagatctgaagcacccggtgcagcctccgagaagaacaacttctacagagatgccagggacagccgaggtagcggcggtggcacaggaggaaatgctgcctgtgcccaaagcccccttccgcggacttctaagattaggagcaaactcaggggtaggggctgggggtgcaggggaggggattctgagccacctgtccgcaagcaatagtcctattttgggctggtggcttctgagaggtgactcattgtggactcaggatgaccaagacaaagcaactctggctgattccagccaggaggattgaggcctgtgagttatacctgtggttgaaaaccgaagcttcccttgcccctgctccctccagtagtggccccttggggctatttgtgtcagaatattgaatgtgcgtgtgtgtgtgcgtgtgtgtgatttggggtgttctttttgtttgcttggttggttggtttttattggggcttcccccctcaagttctctgatgggcatgagtcaccctccggctgggggttctcatccgtgtcaatgtccgagccgcaagcttattgctaagcacagggtacggcccctctgtgtctcggggagcactggggatttgaaaatgccagtcagggttgtttcttacagaattcgttcctgtaacaatagtaatactaagggctgcatctcaggctgaccacagggcaggtgccaagttaagtgttttcatgcactccctctctcaccacctgggaggcaggtatgattaaccccctgcagaaaaactcacagtggggaagcggtgccggaacccaaagtccaggctccaactccctggacgtgacatgctcgccagccggggtacaccctgcacaatgctgggagcatctccttgatgcctccaccatcaccgcctggagcgctgatccactcagcacattctggctaagcatctgctgtgtgccaggccccgtgctgggcagtgatgggaatgaaagatgagttagatctcatctctgcccccggggagcctcccatctggtgggagacacagacacgtggatctttgctggaaagggtaacaaggccatggaaacccaggcaggagcgttctagaaatccatccactttcaagtaggacttccatgcccgtaacatccacccaccgagctaatcacccccactcctgccccgctgccctgggacacctatgagatggcatcacctaaatcatcacaaacatctccaaaggccatgctgccagtgtagacacactcattccatgggtgttagtgataccaaatctcccccagctcttagctcgggaggccctgcttgatcaatgtgtgtgtcctctgacgcagtttcctcatttcatcagacctagtgttctcacactgaccacccatccattcaccagacacgacagtgagcaaggcaggtccctgctcactgtgctagctttctagctggggcaggaagacagtgaagaaggaaggtggcgaaggcagtgagtgctctgccgggaactcagtgccaggaactcagttcgagggacacgtgagtgagacccttgtggacctggggtggtctgggaaggccgccttgagcagatgattgaagcccagatttgaatgacacacaggagccagtaatgggcgttaaagataggaaaagagcattccaggcagaaggaacggctagtgcaaagatcctgcggcagccacaggcttggtggtttcaaggaagcacaagaaagccaggtggcacaagaaagccaggtggctggggacccagagggaaggcagaaggagatgagggtgatagtgcccagctctgggctctgctgtgagtcaagctgtgcaaacacaatgtcctgcctttggaaaagcagaacaaacttgctagggtataaagcatcctccattctgcctggctgtccatcctctcaacagccccatgaagaaggggctctccccattttatggacaagaagacagactcagctgggtcaagtggcttgcccaggatcacacaggtcagctgtggaagacccaggcccctggcttcagtctttgggtccagctgtctcctccaggcagtgctgccagtgtccaggcatatggcttggcaaagtgggagaacctctgcttggggtctcgattggagaaaggaatggcttcctctcccctgatgtgagccgtcccagggccatgttgccgtaagggggtgcacagcctgtccactagcccagctgcggaagccacagctgtgtcccacgtgcagtgcctcagaaggcagaggaagccttgaggtgggggcccaagacccagattctgacatcagctctgccactgagaacagcgtgacctcaggcaaggtctgttacctcagtttccccatcggtaagaggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctgaacgtgccctgcacctagagaagcagccttctcacccgcctcacctggctgctccagcggccaggccagccacctgaccatgaccattgctgatgtgcaacaggccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccgagtgcctgccacttgcctggccctgtacccagggcccatctgggagccattcctgctatagctgggaccacttgtgaaacggctagttgtgcctaacagacatgctcagattcacaaaatgaattcagaacacttacctgtcccacccgtgaaagtgaccttggaggtgtcattgccccccaccaccccagtttctagtccaagccaacagctggtgctagatagatgcttgatgaatgagcagatttgactgttagttactctgtacctaaaactcctatctttacatcaaagccctgacagatttgcccttgacagactgaaatccggggctgctgcagggttcacctccaggaggcaccattcacgacactgtcccataaatggtaatgggctcccagggatactgtttacatagactgcactgagaacggtgacccttaggtttgtacaatgaggtaccctgttgaatgaccctaaaccagcctccaaaatgtgcaggatcccacattggtcagcgccaaccctgagcacaggatctaaaactatagatgatatggccaccctggccacagctggaaccaagctggtggcccaagagagagcctcttcttggaattgcatgtcagtttctcatacgcagtttcttcctatttttcccatttcccgttttaaagctagtggcatacctcacagtcaaataaccaagtggtcagtgtctcgacaatgtgcagtaacgaggtgggggctgcaagggtgaggggctcagtcaccttaacaaggcaggagacctcccacaaaaggctgatgtgtcgtccccagggccagctggacaagggcatgcagcgcaggggtagggggatggaaatattttctctcccgtaaactctgacttcatgtgagcaggcatggggtctccctgagagctgataaccgggaaaaccaaaaccaataatattcctaataataatactagaatgtaagaataatcatgtgtttttcactgaccgctgttgctctgcttttgtctttatatacagtagtttttataacaatgtccctaggttttaataaaggagtgtcatgtcaactgttccc

SEQ ID NO: 10811 - DNA, 6751 bp, Homo sapiens; identical to SEQ ID NO: 10810
  ENST00000381176

SEQ ID NO: 10812 - DNA, 6924 bp, Homo sapiens
  ENST00000378814
atgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatcataaggtactggacttcgttacaaagcaacttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgggtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcagattttaaaacactaatcatttgtctttaataaccctgcctttagtttcaaatctaacttaccatatttcta

SEQ ID NO: 10813 - DNA, 4009 bp, Homo sapiens
  ENST00000502297
gaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatcataaggtactggacttcgttacaaagcaacttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgggtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcag

SEQ ID NO: 10814 - DNA, 5941 bp, Homo sapiens
  ENST00000259711
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaca

SEQ ID NO: 10815 - DNA, 5707 bp, Homo sapiens
  ENST00000378843
cgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaa

SEQ ID NO: 10816 - DNA, 5747 bp, Homo sapiens
  ENST00000378826
ccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaa

SEQ ID NO: 10817 - DNA, 5538 bp, Homo sapiens
  ENST00000636847
atgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatggtggcttcccgataataagcctgtctgcctggtggtcatccccttggtggtcttatttgaagatcctctttcctctcatgtggtttcagacgaagctcctccacaaacactgggataaagacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 10818 - DNA, 4200 bp, Homo sapiens
  ENST00000358380
aacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggtaaatgcttgacttgtctgtactatgcagaatagagcagagttgtgtcacctgtgaagcagcagtgtgcattaacaagctgagtgctgcatgtggacatgcacggtcatcactccatggttcccgttctcgaattcctctttctcaagcatgcagagtcatggtagaatctcttgtttgttgttgctgctgtggttttatttctttgtgtttatggcttttcaaagtatttttttatgtttcaagtgagaaagatgttttctaggtgttttgaaaagattaaaggccttttttaaaattatttttcttttttgtctttttggggatttctgattttgttttttatagagatagggtcttgctgtgttgcccaggctggtctgaaactcctggcctcaagtgattcttttgccccagcctcccaaggcactgggattgcaggcatgagccgttgtacctggtcaaaaggctgttttttaaataagactaattatgctttttgccacagaatctgtttattcctgtcatatctctccagtagtttaactctggcctgcagaattggctgctgcattactcacatgtaataagagtgttagcattgcttttctaacttgcatgtacttaatatgtattttggccgttgtcgtctttgtgtgtgatgcatctgtgtgtcttaacctttgcagagcatgcctccacctcaggcacataaccctggctgcattgtaccctcaggaagcaatggcagcagcatgccagtagaacacaatagcaaacgtgagaagaagattgtaagttccggaaccatttctgtcatattgcctggtggtgggtttaaggccctttcacagacaatcatccaaatgctagaagaaattaagacatgtattgggtctttgtcttaaagaaaataaaaatgtgaccattggtaatgatattttgcatggatgtggccatgacctacaattttatcttatttatttatttattttttgcttaagtttgcttagaaaaagggagaaaggcacttttattgcttctggcctttataaaaagtgtaacaaagagatctttttaataccaaaatctttctaatgtgcctatacatattgcctagattctgaagttaatctacctagaggaagtgcacttacttggagtaagtaatcatgcatttaatgcatttagctgtggatatgtttggaagcttttttatgttgcctgatgctattgccaagataattctgtagttagagctgcactacaatctatcataatcacccttcatcgtctcactgtctagggtagcctttgttaattagctggcaaaatatattccaataccttggtgccagccttgcattcaggatggcttatatatattttgccacaggtaggctgaaactctacccacaaaacctcattccttagcacttggttttaaaattattaatttgagatacagttttaaaaacactgcataccaggcaccttaggttataaattatacctcaatttacaaaaaaaaaaaaaaaaaaaa

SEQ ID NO: 10819 - DNA, 810 bp, Homo sapiens
  ENST00000506044
ctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaa

SEQ ID NO: 10820 - DNA, 602 bp, Homo sapiens
  ENST00000514714
agttgctacgggaatgtggggattgaatgggaatgcatatgagcaaactttctgaggtgatagggcaggttacactcatatgtgcatttctcaaaactcatcgagctctatactcaagatgtggacatttcagtctacctcagtaaaataaataaaaagaaacaatatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtg

SEQ ID NO: 10821 - DNA, 738 bp, Homo sapiens
  ENST00000503342
agaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagaggaaagacatggaatcaacctaaatgtccaacgatagactggataaagaaaacgtggtacatgtacaccatggaatactatgcagccatgaaaaacaacaagatcgtgtcctttgcaggaacatggatggaactggcggccatcattcttagaaaacgaatgcaggaacagaacaccagataccgcgtgttctcactaataagtgagagctaaatcatgggaaccgatggacagaaaggggaacaacagacactggggcctgtgggaggaggagggagaggctcaggaaaaaaaaacaaaaacctgccaagtactatgcttactacccgggtaatgaaataatccatacatcaaaccccttagtcatgagttgacctgtataacaaacctgtgcatgtacccctgaacctaaaataagtcaaaatatttaaattttaaaaaacaaaagtatctgataaagaaggtggtttgcttttaaccatagtgtttttcagttaaatagttaaaaatatttttttgatttcccttaattccagattgattttctttggggcttaaattcttaaaa

SEQ ID NO: 10822 - DNA, 529 bp, Homo sapiens
  ENST00000507576
cgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaa

SEQ ID NO: 10823 - DNA, 212 bp, Homo sapiens
  ENST00000505588
ttctaacaccaaacagggagaaaggaaacctcccaaggtatttgcctttgattattgcttttggtccatggatgaatctaacactacaaaatacgctggtaagttttctccctctacacctgacagttgggcttctggcctcttcttccattgagtttattttctttaattcctctggagttttactttccctgtgtaattcacacctgttc

SEQ ID NO: 10824 - DNA, 1330 bp, Homo sapiens
  ENST00000502704
cgggatggcccgcgcgcctcggcgctgcctctcggagctcacggcggagcggcggcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggctggtcacagtggctcacatctctaattccagcactttgggaggccaaggcaagaggatcacttgagccgaggatttcaagaccagcctttgcaacatggcaaaaccccatctctacaaaaaatttgtttaaaattagctggacgtggtggcgcatacctgtggtcccagctactcaggagactgaggcaggaggctccagtgagctgtttgagccactgcacgccagcctgggtgacagagccagaccctgtcttcaaaaaaataaaaaattaaagtggcgtgaggtgaattgcatcagaccccacatatgaataaatggatggttggcaaagtgttatatataataagtacaattccttaggtgtccttaggtgtactactaaagtgggtttgtgatagcccatatatttagtcatttatgttcaatagtgttatattcatttgagaaattattttaagaaatttaaaattaagaaagttttaaaagtcctttagtaattagagatttctctgggtgggtggatacggttgtttctaattatcccacacatttaatcatttatgttcaatagtgttgtattttttgagaaattattttaagaaatgcaaaattaagaaagatttaaaagtcctttagtaattagagatttttctagttgggtggataagggttatttctaagtatcttttgagtattttttgtcatatatttcgttttttaggcatgattaaaagtgtatttgaggactcttagacacataaagttgaattcctcagattgagagatagttattgctttttaattttgttaagatgctcagctgttggataaataatgcttttgttaaaatcctgtggggcattcatccaacaaatggggtataagaaaggaatgtgtgtttgtgtacatgttcttctatctgttggtcctaaagagtgtaagaaggtaaatttgaccagtgaaattcataattacagagttttatttggtaatccattaataaatcattttctgaaagca

SEQ ID NO: 10825 - DNA, 8745 bp, Homo sapiens
  ENST00000524189
ggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatcacagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtctcctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctcaggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgc

SEQ ID NO: 10826 - DNA, 1267 bp, Homo sapiens
  ENST00000523130
ttgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgcct

SEQ ID NO: 10827 - DNA, 2630 bp, Homo sapiens
  ENST00000522355
gcccccggccccctcccgccgggtcaaccccgaagagtcgccggtggccgcggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaaggtgaggttgccgttccttgaaaaaaacaaagatctcattggataagatcgcctgatatttcctggtgttatttaagcttcagatccctgtctgtgcctgccccaagtccagatcctttgtcctccatgcttttgggtagaattgacttccttttccattctctacctttgagtgtatgtatattttatctgctaggggaatatactctgcatctcacctggccctgacagttcatttcactcaactttcttccttcaaatctgtttaaattctttcttagaagtcttttctgattaatcttccccgaatgtctttttttccttccttatgctaccactctacaaccccttctccacaagttaggtgttcattttgcttatgttattttctacttggaatagcttgctctgtaaaactgctcattagttgtgtcatggtgtcatgtatatattcaggatcatactttttttggtataataaatttaataaaatgtagggggaaagtcccatcacaatcttc

SEQ ID NO: 10828 - DNA, 2765 bp, Homo sapiens
  ENST00000521515
ccccgaagagtcgccggtggccgcggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaaggtgaggttgccgttccttgaaaaaaacaaagatctcattggataagatcgcctgatatttcctggtgttatttaagcttcagatccctgtctgtgcctgccccaagtccagatcctttgtcctccatgcttttgggtagaattgacttccttttccattctctacctttgagtgtatgtatattttatctgctaggggaatatactctgcatctcacctggccctgacagttcatttcactcaactttcttccttcaaatctgtttaaattctttcttagaagtcttttctgattaatcttccccgaatgtctttttttccttccttatgctaccactctacaaccccttctccacaagttaggtgttcattttgcttatgttattttctacttggaatagcttgctctgtaaaactgctcattagttgtgtcatggtgtcatgtatatattcaggatcatactttttttggtataataaatttaataaaatgtagggggaaagtcccatcacaa

SEQ ID NO: 10829 - DNA, 1750 bp, Homo sapiens
  ENST00000523968
gccgaacgagttcctcggcggctgcaggatgggggactccaaagtgaaagtggcggtgcggatacgacccatgaaccggcgagatttgactgtaaggagccagctgatacaatatggtcagattccattaagcagtggttttaagaaactctcatggacctctgggcctgaggaagtgaagagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcag

SEQ ID NO: 10830 - DNA, 1965 bp, Homo sapiens
  ENST00000522846
gaagagtcgccggtggccgcggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggtgtttgcttatgatcattgtttctggtctatggatgaatctgtcaaagaaaagtatgcaggtaatagaatccagcatcctgtcaactactgatggtgtagaagaggggttcagtattttttcccttacacgattgcttggcaaaccccccaaactgtgtgtttcctctgctgtcacaccacaataacagtcatcaacacagaagatgacttaatgtgaccaaatgttgggggagttttccctgcaccccaagcggcagacactggctgggtgtcctctaactcagttccgatgctctctacctggggacagcgtcagatccacagactgagggctcagtcccacaagaccgctccctccttcccaccagcgcaggtccaggcctctagaacttctgacctactggcttccaattagggttcccacaacctcctctttgggtttgattaatttcctagagcggctcacagaactcagggaaacacttgtgtttaggggtttattacgagggattttctttaaaggagacaggtaaacagccagatgaagagatacagagggtgagatctggaagggtcccaagcgcaggagcttctgtcctcatggaggtggcgcggcgccctcccggcgtgtggatgagttcttaccttcctattgggccctgtgtgtttagcaatccagaagctctctgaacccagtccttttaggtttttatggaggcttccttatataggcatgattgtcaaccgattagaaatgtgatttgacaaaaagtgcatgactgaacacagcacgtcctgtctgttcagacttttcttggccattctgtgtagcattccttcctttaggatatgaggcaagaccttgtggaatgagaagctcttgacccacaatcagatgagagtcttgcctccggcaggtaaaaggagggcaggagatcagatagtttcctgaggctaaaatgccccaacatgtaaaagactgcaacaagggttaatgagccaggaactgcggatggtaacctacatctctataattaccataggatatatatgagtaccataggattcttttgcataactgtagaaagtacagacaacaccctcccgtgtttgctattagagtttttaatgttgattggaaaatgggagattcactgtgtgccattcttggtatacgttgatgaaattacatcactagtacacacagtggctattccacattcacacgccccagctcttacatgaggccgggagcacaaggtcgccccttagattgccctggaggcctgagactgggctggagagacaggatggcatagtgaaagaaggggagcaccggccaaggagaaaaggaaccctaggctgcaggcccagccctgcttcttaccgcccctgcgcctttcagtaaatcacctcacctgtcagagcttcagttttctctttttgatggaaaggaatatgccatattctctctaaattttcttttggctctggaagtctgttactctattattcttctaaatgatgactgtctcaagccccatctcaccacaagtttaggactgcagtgacagcctttgattgcctttattccttactgcttttgtcgcctgtttttaaacaatctcttttaaatattaagcatcatattgttttggcttctgttatgagaaagatgaatattatggctgttttgaagttaagattcatttggtctaggtggcccaatatcagaagtataagttaactggtatt

SEQ ID NO: 10831 - DNA, 1980 bp, Homo sapiens
  ENST00000551294
gcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacgactacaacctggccgtcccgcagcgcctggaagagctctacgaagtgtacctgcgggagctggaggagggcagcctggagcaggccaccatcatggaccaagtggcct

SEQ ID NO: 10832 - DNA, 3643 bp, Homo sapiens
  ENST00000389916
gcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatctacaatgagatgatccgggacctgctgaacccctccctgggctacctggagctgcgggaggactctaagggggtgatccaggtggccggcatcaccgaagtctccaccatcaatgccaaggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacgactacaacctggccgtcccgcagcgcctggaagagctctacgaagtgtacctgcgggagctggaggagggcagcctggagcaggccaccatcatggaccaagtggcctccagggccctgcaggacagctccttgcccaaaattaccccagcaggaacctcactgaccccagattctgacctggagagtgtgaagacattgagctctgatgcccagcacctgcagaacagcgccctccctcccctcagcacagagagtgaaggccaccacgtgttcaaggctggtactggggcctggcaggcaaaaagctcctctgtgcccaccccacctcccatccagctcggcagcctggtgacgcaggaggccccggctcaggacagcctgggcagctggatcaactcttcccctgacagcagtgagaacctgtcggagatccccttgtcccacaaagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaagggctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacggaggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttga

SEQ ID NO: 10833 - DNA, 1205 bp, Homo sapiens
  ENST00000551017
gggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcaggtatgcagggctctgcagcaggagctgcagggcagaggtctgctcagatggctcagctcacctggtgagggcagaaagggcccctgtggcttgcagcaccctccttcctctactcactgaactcttggctgtgctgttgatgacatcaccaaggaagctgggggctcttcttccaggaagccttcctagattgatccaaggacaactgggagcttccctagcctgggtgggccctgatcctttacctttcacatgctcattgcttgactttcccaccctaatatgcctgctgcccacagagcacatatatatatggttgagagctaaagctcgcctctagggtgtaacgtgtggcaaaatcctcgctctctgtttgcaatcttggtcctcatgtcaccaggatgaggaaggcagggcacacgaggcaataagtgtgtatcaagtaccagcagcatgctgggtactgttctagaaactgggaaactgtggtgaacagaaaaggccctgtcctctctccattaccttaagtctagtgtgaagagatgaggcattcatcaaagaattgcatcacaaacaaacgagtttgcagctaacaagggcttcaaagaaatgcttagtggcatgagagtaggtaagaaggggataagacctaaacctggaggtcagcgagggcttccttaagaaactgtgcttgacactttgggaggccgaggaggccagatcacgaggtcaagagatcaagaccatcctggccaacatggtgaaacccagtctctactgaaaatacaaaaatttagctgggcgtggtggcacgtgcctgtagtcgcagctactcaggaagctgaggcaggataatcgcttaaacccaggaagtggaggttgcagtgagccgacatcacgccattgcactccagcctgggtgacagagtgggactctgtctcaaaaaaaaagagaaaaaga

SEQ ID NO: 10834 - DNA, 2020 bp, Homo sapiens
  ENST00000359939
gtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaaggtgtccagggtttggggggacaaggagagtgggtttaggggacagggtgagcaggtttgagaggcaaggcggaggggccagggtgggggtagccgtgagacttgggaactcaggccacaaatcctgtgtgactttgctaagctctttaacttctctatgcgtcacattccccacctgtaaaatgggagcagtccatggtgcagccctcatggggttgctgggaagattacataaatgcctggcacataccaaggactcaaaaaatggtaactaatgttataattagggtttttcaggctgggcacagtgactcacacctgtaatctcagcacgttgggaagttgaggtaggcagatcacttgaggccaggagttcgagaccagcctggccaacatggcgaaatcccgtctttactaaaaatacaaaaaaaaaaaaaaaaa

SEQ ID NO: 10835 - DNA, 2094 bp, Homo sapiens
  ENST00000547389
agctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatctacaatgagatgatccgggacctgctgaacccctccctgggctacctggagctgcgggaggactctaagggggtgatccaggtggccggcatcaccgaagtctccaccatcaatgccaaggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaaggtgtccagggtttggggggacaaggagagtgggtttaggggacagggtgagcaggtttgagaggcaaggcggaggggccagggtgggggtagccgtgagacttgggaactcaggccacaaatcctgtgtgactttgctaagctctttaacttctctatgcgtcacattccccacctgtaaaatgggagcagtccatggtgcagccctcatggggttgctgggaagattacataaatgcctggcacataccaaggactcaaaaaatggtaactaatgttataattagggtttttcaggctgggcacagtgactcacacctgtaatctcagcacgttgggaagttgaggtaggcagatcacttgaggccaggagttcgagaccagcctggccaacatggcgaaatcccgtctttac

SEQ ID NO: 10836 - DNA, 841 bp, Homo sapiens
  ENST00000549637
ttttattccaacccctcaatgggggacgggagacacattcttgaaacagctcattgatggttcagaatattcctaatagcaggtaaatgatgccaatggtaggtgctggggcaagacaggaacaggaggtgggggtggcctggtggggtccagtggaactctctggagactgtgagtgggaccctgaaggctgggaggacattccagaaaggtgggagcagggagagcacaggttccaaaggcaggaaggggatggcgtctgtggtgggtatggggagagcaggacaggtcttcaactggagtgggatgttcatgcaggagcggtgagcccagagaaaatcagagagatgggggtggcccttcaacaacgggtggaggaatgaggacgttccccgcaggcattaggaagccactgaaggttgatgagatctagcagtgagtgtgacaggaggttgtggaagtggaggaaaggaggccattactgtcacccagaaagactgggggaggcagggggaagaaaggccctgcaggcaggcctcggtgagtgcacctggggtgactgcatcccctccgctccatacgtgttccctgcaggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccagg

SEQ ID NO: 10837 - DNA, 1980 bp, Homo sapiens; identical to SEQ ID NO: 10831
  ENST00000551294

SEQ ID NO: 10838 - DNA, 3643 bp, Homo sapiens; identical to SEQ ID NO: 10832
  ENST00000389916

SEQ ID NO: 10839 - DNA, 1205 bp, Homo sapiens; identical to SEQ ID NO: 10833
  ENST00000551017

SEQ ID NO: 10840 - DNA, 2020 bp, Homo sapiens; identical to SEQ ID NO: 10834
  ENST00000359939

SEQ ID NO: 10841 - DNA, 2094 bp, Homo sapiens; identical to SEQ ID NO: 10835
  ENST00000547389

SEQ ID NO: 10842 - DNA, 841 bp, Homo sapiens; identical to SEQ ID NO: 10836
  ENST00000549637

SEQ ID NO: 10843 - DNA, 9897 bp, Homo sapiens
  ENST00000332129
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcctcgggcattggcccccagacccccgcctctgatccacgcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaagaaaacccatgacaaagctcccctgggggcctctgagtgcacaggcctctccatctgcccagcaccccaccacctgcagtccacctccccgtaagccatgcttgcctcccagccccaaccacatttggggagtttggggaatccagttcatcctctacttttgggggcagccagccaagcccactgcaagagctgaccggcacccctccactttgtcctccaccccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcatgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaa

SEQ ID NO: 10844 - DNA, 5428 bp, Homo sapiens
  ENST00000461742
gcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaa

SEQ ID NO: 10845 - DNA, 5389 bp, Homo sapiens
  ENST00000360529
gcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaa

SEQ ID NO: 10846 - DNA, 5519 bp, Homo sapiens
  ENST00000422435
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcctcgggcattggcccccagacccccgcctctgatccacgcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaa

SEQ ID NO: 10847 - DNA, 3065 bp, Homo sapiens
  ENST00000534043
ctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctggtaggcacatggtgggtcatcagccccagcacccacacagctcagtctcagacccctccaaggccctgcagtcctacacctgctgagtcctccttggacatcttgccaattagcccttcactctcaggcgtcacccctgtccccagcttccccatttcaccaacttatccatgtgcctataaacccacccaaggagcaagagggctgctggggccaaagaggcagctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcggtgagcatgctcctgggcattgcccagcactccccttggagctagtgctccatatgcaccctctgccctgcagcctcaccctaacttcctcagcatccctcccacctccctattaccatcatccactttggacatgactcttgagcatcagttgtgtgccaggcatgctgcttactattagggactcacccatgtgaatcaagcatagtctgagccctcaagattttagaatactaagtccaagaaagaagggctccccagcttttgttgcatagatcttgtgcacagggcagacactctccagggtgttttcatatctgctgaatgtgttgtgttggaacaggtaagactgctagactggcacagaatcgttgatagaggggcccacaggagtatccagtgtgctgcagaggggcagaggagagagttggccttacttgcatggatggtcagagagggcctcatggaaaaaggggccttttatatggattttgaagaatgaatgaggtaacagcaaaatgagatgggacagccattctaggtaaagaacaagccatgcacaaaggaacagagtgggaaaaaatgggtcctttggggtaaatgtctaattctatgtgactaagacagaagtcaccaattggtagcccatggcccaaatctggcacatggatgagtttaggtttggcttgcacttgttttaaaagaatacaacgtagttgtcaacctttctgaaaatcagggagtttcagttttgctagaaaattttcaagatctaacaactcatggtaccaagttggctggagaggcataggggctgccccttctagactgagtctgggactctcttagttccagtctctaccactccctattgtcttacaaccagcctgactcatttatgccaactgcctggcagagagggttttgacccttggactagactttatggagatatgaaaatacactgtggaaagttaggtcaagtaagattgtgagaggccttcagtggctggttacaaaatttggactttttattgtcaaggagaactgtgtaaggtttttgatcactgggggccagtagctgtgttttaggaaacctggggcaggggagactggtgatgcgccatatccaggggaaggccagggcgctggcagagggaggggcatcatcagccccttacccccccaaccgcgagctctgctgcctgactgctcccctttgcccctgctcccagggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggtgagttgggctgtgccaggccaggtcagagcaccaacgggctaggactccctcccccgacatccaccccagagtatcaggtggactaagccagccagtcaattcatagttcaactcatttatgcattttttttcacttgattttaaaacatttttgtatggcacaagtaatacatgaacacatccttcttgttcaacatgcaaacaatacatcactatatgaagtgaaagattaaaatcgcctctccctgaaccctccaccccaagccctctctacttctcagaaggaacctctatgagcagcttggtgtgtattttcccacacctttctcagtatttgtttcaagtatgaatatgtattcatatacattcttaaatgtgtgtatgatatagactactttttctatgtatgagattatatatattgctctaagacttccctttttcatttagcattatgttttataaatctttccatattaaacctacttctggttcacgcctgtaatcccagcactttgggaggccacggcaggagaatcacttgaacccaggagtttgagaccagcctgggcaacatagggacgcctagtctctacaaaaaatacaaaaattagccagatgtggtggcacatgcctgtagttcatgttacttgggaggctgagatggaaggattgcctgagcccgggaggctgaggctgcagtcagctgtgactctagcctgggcgacagagcaagaccttggctctaacc

SEQ ID NO: 10848 - DNA, 7287 bp, Homo sapiens
  ENST00000407071
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 10849 - DNA, 1189 bp, Homo sapiens
  ENST00000479506
cctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggactccgaagctcttgtcacacgtggcaggggccggttagaagactcggcggctgcgccagcgctgatgagcgaggacagaggagcatgaaactggtgctttcctgtaaaatattcaaaagcagatggcctctggatcagtgccagagccattccccgggcagagaagcatctagaccttgtcactaccaagggtgcggctccacacccgcgggacccgagcctctagaaatgagggagaagacgactctgcctttctgcaatttagacgtcgcaaggatgaaaacgatgcggacaggctttccagcagtgagcctggggaaatctgcgtcacatgggcgacagaaggtccctcgaatccctcaatccccgtggcccgcaccactgtgtaataatctccaaaggttgcagtaggaa

SEQ ID NO: 10850 - DNA, 12113 bp, Homo sapiens
  ENST00000366518
tcctgagatggccccagatctgcaagagacatttgagagaagctatttattagcagacgtgaagaaatggattctgcacttgattatttagccatgacttatcaatgatgatggattggaaagcagtagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattct

SEQ ID NO: 10851 - DNA, 2262 bp, Homo sapiens
  ENST00000483253
tttctcttttatcttctcccctgtggtagtgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacg

SEQ ID NO: 10852 - DNA, 1191 bp, Homo sapiens
  ENST00000615502
cctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggactccgaagctcttgtcacacgtggcaggggccggttagaagactcggcggctgcgccagcgctgatgagcgaggacagaggagcatgaaactggtgctttcctgtaaaatattcaaaagcagatggcctctggatcagtgccagagccattccccgggcagagaagcatctagaccttgtcactaccaagggtgcggctccacacccgcgggacccgagcctctagaaatgagggagaagacgactctgcctttctgcaatttagacgtcgcaaggatgaaaacgatgcggacaggctttccagcagtgagcctggggaaatctgcgtcacatgggcgacagaaggtccctcgaatccctcaatccccgtggcccgcaccactgtgtaataatctccaaaggttgcagtaggaaga

SEQ ID NO: 10853 - DNA, 12690 bp, Homo sapiens
  ENST00000629409
aggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattcta

SEQ ID NO: 10854 - DNA, 2571 bp, Homo sapiens
  ENST00000626550
tcctgagatggccccagatctgcaagagacatttgagagaagctatttattagcagacgtgaagaaatggattctgcacttgattatttagccatgacttatcaatgatgatggattggaaagcagtagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggaca

SEQ ID NO: 10855 - DNA, 6103 bp, Homo sapiens
  ENST00000375712
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 10856 - DNA, 8611 bp, Homo sapiens
  ENST00000458470
ggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagggacctgtttgtcttgctcattgctgtgtcccaagcacagagtcgctgttcagtaaacggtccttcagttcatgagtagacgagccagaacccagatgtgtttctcaggctggtgtcactctgacttcccccaggctctgactgaatcccatcgggacaggggccagcatctctggtccactcctggccctcacagttcaatggaacatagtaagccctctgtaaagtctgtagaaccagaggaagaccaaattctgattctagaagcctccccaagagtccatggaacacacatgtaactgcacacacacacacacatacacacacacactctcaagagccctgaagatggcatggcatttgccccagtcccctatgtagcagcagcagtattcttggcatgccttagtgccctcagccctctagagctgggtagagtctactaacttttattttcttttatttttactttcttttatttattttttgagatggggggggtctctgtcagccaggctggggtgcagtggtgcgaccatacctcactagtcagcctccaactcctgggctcaagccatactcagcctccaactcctgggctcaagcgatcctctcacctcagcctccaaagtagctggaactacaggcatgcaccaccacacctagctcgttttaaattttttgtagagacagggtctcactgtgtggctcaggatggtctcaaattcctggccttaagcgatgctcccgccttggcctcccaaagtgctgggattgcaggcatgagccacataccctgccagagtctttcaacattagatctcccactgagacatcatctcctggatccaaaggccttactgacagagatgtgtggcatggccccatgcggggtgtgaaccagcctcctggggcaatcactaagacaggaaaggaaatgaagacagaaaaacacacaacatgggatctggggccactggtgtccagagcatatgcaaagtgtgtgcagcaactggccaaggggccttttgctccgaacatcccctaatggaagcccagcctttgatatggacacatgcttgacagcagtgcaccttcccagagttcactggcctctgcaaatgggagaaattgatgcaatgttttgaaaagactttccagcaatccacctgggatcagtggagccacggatgacaagaagtatctgagttcactctaggccaaaatgtgggattttcaaaaacattttctggaaagcagcctagccagtgactccagcccagtccctgctagaattcaactggctctaccaatcccttgacaagaagtagggtggacggaggttggaggagggaagttaaaatgtagcttgcccagatcttgctaaaaaggagttttagaaagcagatagagaaattgtggtatactgaatacatcattttaattcttcaccaccagtatagaattacacatccaaagctttgtcatggcccactttgactaatgtggtgttggcaaacctgatccaggcagaggcttgaattgtgctctcatggttgagcttgcctcttgctccagtgatctctcttgggatgaacatgccatgggtagctgctgccccttcagcctggaacatccagagagcagacctgagcccagtctacagcctggagcagagcctcccaggcaagcccagcccagatcagctgaactatggctcacccaaagacctattggcatgagaatatatgctgcttgtcataaaccactgaggtttagagtggtttgttatatagcattaattgtagcaatagcagactggcacagaaattggaacccagagacagtatatgactggatctaggatttctcagtgcagagttcattgtctctccatgcagcctgtggaaaggcactgagagcatcctgtatatggaaaagcaggaccaccacctacagccatgatgaagcaacaaggacctgatttaccctcctgctttaaatgactaaaaatgagacaaaatcctctatacaaaccaatggttttcagccattggataacaagcaatatagggtatgattgatccgcaagagaagggaaacaagtgaggggagccctatgattgctccaacttactgcctgcagtgagttttcaggctgcagcccaggaagggggaaccaggtagagcccagtggtttccctgagttgaggaaatggagctgggaatccagggaggacaaagtggcttaaatttgcaaggcagagtcccagggatgagagagagagaaggagagagagaggagaaaaaagagagagaaagagagagagcatgctctggagatcttcagagggttacccttgagtcttcagctaactaccgatcaacatctgcatgtgaagaaattacccaaggcaggggaaagaaccaccaggaggaagcaggtggaataatttcctgagataacactgtgttgggaagagttcatgtttccaacagccagagtggagaaacctcccaaaacagtcattgtatagagacacataaggtactgcctcagaagtggggccaaattagtcctagatgatagattgctctggtcccacctaacaaagcttaaaaagccagccccaaaggagtcaaattgtttccagtaagtttccaagtaacttcaatgagtcccaaaacaaagcttcaaaatatctaaaggaatatgaaaaacaaaccaaaaagaaaccagcatccaacaatatagaatccacaatgtctggtgtccattaaaaaataatcaggcatgcaaagaagcaggaaaatatgggccatgagaggagaaaaaaccatcaatagaaatagaggccgggtgtggtggctcactcctataatcccagcactttgggaggccgaggcaggaggatcacctgaggtcaggagttcaagaacagcctgttcaacatggggaaaccccgtctctactaaaaatacaaaaaatagccgggcatggtgttgcgtacctgtaatcccagctactcagaggctgaggcaggagaattgcttgagcccaggaggcagaggttacagtgagccgaaattgtgccattgcactccagcttgggcaacaagagtgaaactctgtctcaaaaaaaaaaaaaagaaaaaacaaatagaaacagccccaggcatggcacagttgatagagtaaatagacagaaacattttttaaaatgcaatgggtgtgtgtttcaaatctaggcagaaaaaatgctccttgtaattccttaaacataagcatgtctcattcatctggtcattgttttgacaaggatgtgccatccattgtgctaagttctgaggagtcagaggtgacagagacagagaaagtgccagcattcttggaaccttctaacgaaggagagggacaagccaggcatggtggctcacgcctgtaatcccaacactttgggagactgaggctggcggatcacgaggtcaggagtttgagaccaacctggccaacatggcgaaaccccatcgctactaaaaatacaaaaattagctgggtgtggtggtgcgcacctgtaatcccagctactctggaggctgaggcaggacaatcacttgaaccctggaggcagagtttgcagtgagctgagatcgtgccactgcactccaacctgggcaacaagagcgagactccttctctgaaaaaaaaaaaaagagagggacaataaacaagtaagcaagacaatctgattaagaaggagttggggttagctgggcatggtagcaagcgcctgtagtctcagctactcgggaggctgaggtgggaggatccttgaacccaggaggttaaggctgcagtgagctgtgatcacaccactgcactccagcctggatgacagagcaagaccctgtctcagaaaaagaagaaggagttgggggtggggtaggatgggcttggactcactatcaaggtgggtgggagtgtgagaacccggcaaggtgcaaagagagaagcagggaagggaagcttaggacaatgatggcaggttgggtattgggtgatgggaagaggcaaaggacgtggagcttggcaaaaaggggacttgtggggatttgggccatgtgagcatgtgggggagacagtgttccttccataacacgtgtccagggactgccagggctccgaggcagagcaggtgtagagaggttggctgtgaatgttggatgttgaaaacatatgtgtcaaatgtgggaggaaaaagcagtgtttccttgaatacaagctcctcctcaccttgcgaaaagtggcctctgagtgtagccctgaatgcatctcccaaggaataggaggaagcagcaaccttttcagagttaactgctttatttgggttttccatggcctcgtgccagccagcagggctgagccagtttcacccacactgagagggaactcagcaaagagcaagcagcatgccagctggtactcttccctctccattcactcagctcctgatctcaggagggcagcccctccccaggccagcacccctccccttctggccccaggtgtgggatgttgttgttttcttttctccgaaacatctcctgggtttgtcttttccatcactgtctttagactgaggcaagcagtccccatgccttcagccccatgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 10857 - DNA, 9082 bp, Homo sapiens
  ENST00000287152
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagggacctgtttgtcttgctcattgctgtgtcccaagcacagagtcgctgttcagtaaacggtccttcagttcatgagtagacgagccagaacccagatgtgtttctcaggctggtgtcactctgacttcccccaggctctgactgaatcccatcgggacaggggccagcatctctggtccactcctggccctcacagttcaatggaacatagtaagccctctgtaaagtctgtagaaccagaggaagaccaaattctgattctagaagcctccccaagagtccatggaacacacatgtaactgcacacacacacacacatacacacacacactctcaagagccctgaagatggcatggcatttgccccagtcccctatgtagcagcagcagtattcttggcatgccttagtgccctcagccctctagagctgggtagagtctactaacttttattttcttttatttttactttcttttatttattttttgagatggggggggtctctgtcagccaggctggggtgcagtggtgcgaccatacctcactagtcagcctccaactcctgggctcaagccatactcagcctccaactcctgggctcaagcgatcctctcacctcagcctccaaagtagctggaactacaggcatgcaccaccacacctagctcgttttaaattttttgtagagacagggtctcactgtgtggctcaggatggtctcaaattcctggccttaagcgatgctcccgccttggcctcccaaagtgctgggattgcaggcatgagccacataccctgccagagtctttcaacattagatctcccactgagacatcatctcctggatccaaaggccttactgacagagatgtgtggcatggccccatgcggggtgtgaaccagcctcctggggcaatcactaagacaggaaaggaaatgaagacagaaaaacacacaacatgggatctggggccactggtgtccagagcatatgcaaagtgtgtgcagcaactggccaaggggccttttgctccgaacatcccctaatggaagcccagcctttgatatggacacatgcttgacagcagtgcaccttcccagagttcactggcctctgcaaatgggagaaattgatgcaatgttttgaaaagactttccagcaatccacctgggatcagtggagccacggatgacaagaagtatctgagttcactctaggccaaaatgtgggattttcaaaaacattttctggaaagcagcctagccagtgactccagcccagtccctgctagaattcaactggctctaccaatcccttgacaagaagtagggtggacggaggttggaggagggaagttaaaatgtagcttgcccagatcttgctaaaaaggagttttagaaagcagatagagaaattgtggtatactgaatacatcattttaattcttcaccaccagtatagaattacacatccaaagctttgtcatggcccactttgactaatgtggtgttggcaaacctgatccaggcagaggcttgaattgtgctctcatggttgagcttgcctcttgctccagtgatctctcttgggatgaacatgccatgggtagctgctgccccttcagcctggaacatccagagagcagacctgagcccagtctacagcctggagcagagcctcccaggcaagcccagcccagatcagctgaactatggctcacccaaagacctattggcatgagaatatatgctgcttgtcataaaccactgaggtttagagtggtttgttatatagcattaattgtagcaatagcagactggcacagaaattggaacccagagacagtatatgactggatctaggatttctcagtgcagagttcattgtctctccatgcagcctgtggaaaggcactgagagcatcctgtatatggaaaagcaggaccaccacctacagccatgatgaagcaacaaggacctgatttaccctcctgctttaaatgactaaaaatgagacaaaatcctctatacaaaccaatggttttcagccattggataacaagcaatatagggtatgattgatccgcaagagaagggaaacaagtgaggggagccctatgattgctccaacttactgcctgcagtgagttttcaggctgcagcccaggaagggggaaccaggtagagcccagtggtttccctgagttgaggaaatggagctgggaatccagggaggacaaagtggcttaaatttgcaaggcagagtcccagggatgagagagagagaaggagagagagaggagaaaaaagagagagaaagagagagagcatgctctggagatcttcagagggttacccttgagtcttcagctaactaccgatcaacatctgcatgtgaagaaattacccaaggcaggggaaagaaccaccaggaggaagcaggtggaataatttcctgagataacactgtgttgggaagagttcatgtttccaacagccagagtggagaaacctcccaaaacagtcattgtatagagacacataaggtactgcctcagaagtggggccaaattagtcctagatgatagattgctctggtcccacctaacaaagcttaaaaagccagccccaaaggagtcaaattgtttccagtaagtttccaagtaacttcaatgagtcccaaaacaaagcttcaaaatatctaaaggaatatgaaaaacaaaccaaaaagaaaccagcatccaacaatatagaatccacaatgtctggtgtccattaaaaaataatcaggcatgcaaagaagcaggaaaatatgggccatgagaggagaaaaaaccatcaatagaaatagaggccgggtgtggtggctcactcctataatcccagcactttgggaggccgaggcaggaggatcacctgaggtcaggagttcaagaacagcctgttcaacatggggaaaccccgtctctactaaaaatacaaaaaatagccgggcatggtgttgcgtacctgtaatcccagctactcagaggctgaggcaggagaattgcttgagcccaggaggcagaggttacagtgagccgaaattgtgccattgcactccagcttgggcaacaagagtgaaactctgtctcaaaaaaaaaaaaaagaaaaaacaaatagaaacagccccaggcatggcacagttgatagagtaaatagacagaaacattttttaaaatgcaatgggtgtgtgtttcaaatctaggcagaaaaaatgctccttgtaattccttaaacataagcatgtctcattcatctggtcattgttttgacaaggatgtgccatccattgtgctaagttctgaggagtcagaggtgacagagacagagaaagtgccagcattcttggaaccttctaacgaaggagagggacaagccaggcatggtggctcacgcctgtaatcccaacactttgggagactgaggctggcggatcacgaggtcaggagtttgagaccaacctggccaacatggcgaaaccccatcgctactaaaaatacaaaaattagctgggtgtggtggtgcgcacctgtaatcccagctactctggaggctgaggcaggacaatcacttgaaccctggaggcagagtttgcagtgagctgagatcgtgccactgcactccaacctgggcaacaagagcgagactccttctctgaaaaaaaaaaaaagagagggacaataaacaagtaagcaagacaatctgattaagaaggagttggggttagctgggcatggtagcaagcgcctgtagtctcagctactcgggaggctgaggtgggaggatccttgaacccaggaggttaaggctgcagtgagctgtgatcacaccactgcactccagcctggatgacagagcaagaccctgtctcagaaaaagaagaaggagttgggggtggggtaggatgggcttggactcactatcaaggtgggtgggagtgtgagaacccggcaaggtgcaaagagagaagcagggaagggaagcttaggacaatgatggcaggttgggtattgggtgatgggaagaggcaaaggacgtggagcttggcaaaaaggggacttgtggggatttgggccatgtgagcatgtgggggagacagtgttccttccataacacgtgtccagggactgccagggctccgaggcagagcaggtgtagagaggttggctgtgaatgttggatgttgaaaacatatgtgtcaaatgtgggaggaaaaagcagtgtttccttgaatacaagctcctcctcaccttgcgaaaagtggcctctgagtgtagccctgaatgcatctcccaaggaataggaggaagcagcaaccttttcagagttaactgctttatttgggttttccatggcctcgtgccagccagcagggctgagccagtttcacccacactgagagggaactcagcaaagagcaagcagcatgccagctggtactcttccctctccattcactcagctcctgatctcaggagggcagcccctccccaggccagcacccctccccttctggccccaggtgtgggatgttgttgttttcttttctccgaaacatctcctgggtttgtcttttccatcactgtctttagactgaggcaagcagtccccatgccttcagccccatgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 10858 - DNA, 2394 bp, Homo sapiens
  ENST00000394362
acagtcctgaggggtgcagcgggtggcactggaagggcctcctcagcaggttgtcagccagctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagg

SEQ ID NO: 10859 - DNA, 1330 bp, Homo sapiens
  ENST00000229913
ctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacacca

SEQ ID NO: 10860 - DNA, 743 bp, Homo sapiens
  ENST00000441975
actcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattaaaagcaccaagctcctctgatggagttctcttctgcagaaaccaatgagtgaggcaggatctgtttcagcaaaggccctggtcaggtatcagcatcacacagtgttcctgctggagagaggagacagcatgcaaagtcaagattcaggtggaactgaactgctagggtggattttgttgctgtccctacccttccagaagccctatagcattacagtgctgaatgagaaagagagttaacaaagttattagccccaagacaaaaactagttcagaatttaaggaaaataaacatattagacattg

SEQ ID NO: 10861 - DNA, 582 bp, Homo sapiens
  ENST00000482238
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaagactgggttttaccatgttgcccaggctggtcttgaactcctgggctcaagcgatctgaccctccttggcctcccaaagtgctgggattacaggtgtgagccaccgcgcctggcccctgctttgctttttctgaagaggacgttctcccactgatatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtg

SEQ ID NO: 10862 - DNA, 2035 bp, Homo sapiens
  ENST00000465719
tacccaccatttgtatacaggagtacaacagcacagtgtggttgagactacagggcaaacattgtgctaagttagatttcaaagaatttttgatcaggatgcaaaccaagagaccgtttttgaaaacattgccaaaccagttgctgggagtcctacaggaactggatcaacccagcaagtctgcagttcccaaggtcttcaggatgaggcaccagtgcagttatgtagtatttttccgccaaagtgatatgttttaaactgacagattttcattgttccatttgatgctaatattttcttctaacaatagcttttctcttaatgatgccttttacttatgtaaacatgtttttctcataaaaacttaaatagtcattttgctttttattaatggaatcaccaccaagcaatctttataagattgtcatttatatggctacattaaataacacagttctgttttcatacatagaaattctaataatataaaaaattatgtagccaaaaatattgaaacatttatacatgaaaagcttgagtcacagaaacctagggttgaaaggaacttcaaggtctttagccttcctccaagaaatataacttacaaaagtgagcagaagtttttatatattcacttgcccttaggctcttaatttaactccacactgagcattttcgacactgacttgttttgagaaaggttatcataagggagcttttccgtttctgctacctcaaatgcgtgtatcttttttcttagcctttcttcctttactcttctctcagaaatatttctctttactatccttactacatggagctttgtttccagctaagtttgcttttttcagaagtttatctcctaattcagttccaaccagggttgccagatttagaaaatgaaaaatataggactcccagttaaatgtgaatttcagataaatggtgaacacgtttttagtataaatatgtcccaaatgttgcatgggtcatacccataaaattattcattgtttctctgaaattcaaatttaactgtattttattggacaaccctatgtaaaacccttatgcctgcaaccttgtctgtaaatttcctttgctgaagttcacatctccatcagtgcactgaactacgcagaggacactcttctgtggctgcattttcctctgcctgcagccatttccatctggatcctgctctgttctccccttgctggtttctcagcttacctgcagtcccccattggccactcttcttgagctgtctcctgttggtggcacagcagtgtttattatgcttgacactcctaggttaccttgagtcctcctttactcttgtcctggacaataacaattcctgttcattcttcttccgcagggggatctttccctccttccctcctcatctttacttccccttccccttctccctcctgtctgtccctgcttgtctgttccctacactgccctcattcaggtttctgcccacccacttgcccacccagcctcctgctctagacactccctgtccaggccatcttgcactgcctggttaatcattcagaaatattgtaccaattctactctttccctccttcagtgacttactattgtctgcagaatgaagtataagttccttattcaaggactcatatgcaggaactttccagaattgtcctcttcctatttccctagtgccattgacatcgttactttgcatcagtgcctaccaccctttccgatactctcactctttcactataatatattattgaaaactcccttcgggaagttttaaattatgtaatcatttggcatacagataaaaggaagcattattttagtttatatcactgtattagtaaatgttacattatatagtttatcctaataaaatgtaataatattcacattatataaatagcaagaaatgttttgacttttccctatttagcaaatgacacacactttcttgtatttgaattaattagataattaaaaatgtgatttttaaataaaatttaaaatggca

SEQ ID NO: 10863 - DNA, 2386 bp, Homo sapiens
  ENST00000538893
gggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcagtatcctttctgaagtgatgaagaaacttcctctatcctggtttgaaaggggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatatcttcagctcctttgttctctgttcccaaagtcagctgtctcctctgctcaggcttctacaaacaggaaggggctgagtgatgttttggtaactcgttga

SEQ ID NO: 10864 - DNA, 3304 bp, Homo sapiens
  ENST00000360089
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaaggtaaggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcaaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaa

SEQ ID NO: 10865 - DNA, 2874 bp, Homo sapiens
  ENST00000359209
ccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacaggg

SEQ ID NO: 10866 - DNA, 6870 bp, Homo sapiens
  ENST00000368172
acttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcacaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctgtaaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctcctgttgaattttctccacccagaccccaaaaataaatggatccatgatgataattaagagaagagaaaaaaagatattatttttgttaggacaaaccattgtaggtttttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagta

SEQ ID NO: 10867 - DNA, 7519 bp, Homo sapiens
  ENST00000368173
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagtccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcacaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctgtaaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctcctgttgaattttctccacccagaccccaaaaataaatggatccatgatgataattaagagaagagaaaaaaagatattatttttgttaggacaaaccattgtaggtttttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagt

SEQ ID NO: 10868 - DNA, 3470 bp, Homo sapiens
  ENST00000412167
cgctcgcggctctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattaga

SEQ ID NO: 10869 - DNA, 5186 bp, Homo sapiens
  ENST00000288135
cgctcgcggctctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaa

SEQ ID NO: 10870 - DNA, 538 bp, Homo sapiens
  ENST00000514582
ggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagaggtaaatgcttggctttctgcagtgctgtgctttcaagaatttaatatcctgctcttaattttggatgacatatggatgactgagccatagataaaatatttctggctgggtctagaaggcctaaa

SEQ ID NO: 10871 - DNA, 746 bp, Homo sapiens
  ENST00000512959
atatatctcaccttctttctaaccttttcttatgtgcttttagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgtgagtacccattctctgcttgacagtcctgcaaaggatttttagtttcaactttcgataaaaattgtttcctgtgattttcataatgtaaatcctgtctagggatatcacacattttagcagtcaaattaagtatacttcagcaaaatttgcatggtatgctgaacattactacaactaacattcaataatagaagtcctaattctaa

SEQ ID NO: 10872 - DNA, 5191 bp, Homo sapiens
  ENST00000378535
ttaagtgtaaagaataagggagttaacgccaaaaataaatgaacaaaaatgccgtcatgtctggcagctcaggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatcccactatacaaatgcaaatggttgcctggttccatttatgcaagggagccagtactgaattatgccttggcagaggggagactccaaaagagtcatcgcaggaagaagttaagaacactgaacatcagaacagtctgccaagaaggacattggcatcctgggaaagtccgccttttcccttgaccactatagggtgtataaatcgtgtttgcaaaatgtgttatgatgtgtttatattctaaaactattacagagctatgtaaagggacttaggagaaaatgctgaatgtaagatggtcccatttcaatttccaccatgggagagcctaaaaataaattatgacatttagtatctaaggttagaaaaccacgcccacatgctaatatgggtgttgaaaactaggttacttataatgcaaggaatcaggaaactttagttatttatagtataatcaccattatctgtttaaaggatccatttagttaaaatcgggcactctatattcattaaggtttatgaattaaaaagaaagctttatgtagttatgcatgtcagtttgctatttaaaatgtgtgacagtgtttgtcatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtgataacattattgccatgttctacaaccgtaagatgacagttttcaatgtagtgacacaaaagggcatgaaaaactaactgctagctttcctttcatttcaaaagtccaagaatttctagtatatttggattttagcttctgttcaaagcaaatccagatgcaactccagtaagtggcctttgctcttttttgtaccaaagagcccagatgattcctacagtccctttcttctctaacatgctgtggttccttaaatatgagtaatttctctaagatataacccaggtgctttgagaagctgcattaaggtgttcaggccctcagatatcacatggtacacttgattagtaataaaaccagagatcaatttaaattgctgataggtcctgtctcagtgtgtggcattgactgttttcaggaaaatagatacagattaatatgagttatgcgtgtaggttgtgtatagattgagaagatagatacttctcaatctagtagtttgatttatttaaccaatggtttcagtttgcttgagcatatgaaaatcctgcttaatgtgcttaagagtataataaatgtgtacttttgtcctcaaacctagtagctgggttttaacactcatggacatggtcttaatcaatggagttaaataaacaaattcagcaagttattaaatctgacatggtaggagaggggagatgtgtcctgcttattaaatgtgttggtccattgaaagttacatggattgccaatttttaaaacactaaagttgaataaaatgcatgaacaatagaaaaatgctgaacattattttggatgctagctgcttggacattaactgtgttatttctgctttgagatgaaaatatatatttatctttgcttattttatcccagatgtgttctgaatatccttcttcataaatcatggaaaactcactgctgagatagtaaaccatgaaatcgccttttcagttggtgccatgtatctgacagttccatcttggaaggtttcaaaattaccttttaaaatgatctcagaagtctgtagattctcaatgatactgaaagctttgcacctctttggtagaaaccaggtctatttagaaaatggctttatgataaatgttgcctcctgagtgataatgaagtgttcctggatattgtattgtaatttaatgtgcttaccacactgccacattttaatgagtcagagaaaaattaatttttcttcaatacaataatagaacaagtagcctattctcttaaaaagtatgtgaaaagaaaattatgaaaaaatatgcatacctaatgaagtattggttttagtaagaattaaatacatttcattgagctttaaagtactttggagaaactttggggcacgttttcctactctaattcaactaaagttataaataaagagaaaaactcattcagaaatcatggattttaaaaatattttactgcagccaagttttcatttcaaaatgtaatttcagtttggagcttttaggcattatgtatatttaaaaaatatattcttcaaaaatgcattttggcatggtgggatggatgttgcaaaagatatccggagcctccagtctgtcattaactgatatggtaaatcacctctcttctttgggtctcaattttttatttatctatatggtaaactcagagatcactccttaggggtgagtcctattgcaatatgaccgacaaagaagacaaaatagcattgaaactaacccatacaaaatatccaactctggattctgtgaataagtatcttgaccataaaaagtcattgctgttcttgtttctaatgtaaatagtgtccattagtaaaagtgaaattcagtcttaagtagggtgaattggatcaccatttacacaagagatggctttttcctttgcttgaataaacattttggatcacctccaaagaatgaaaaccagtagtacgttttagtcatattagtcaggatgagaaactataagatgtgtgtaacatttggaaatgcaccaaagtgagcgtttaaatcttctcattttattgaaaactaagagcagaaaatgtaaaatgctcatgaaggttttgaatgccaaaagatattttagaatcaatttataaaggggtaattcattaattacactttaaaattggaaagtgggataagaaatctaaagtaaaccagcttatctttgaaacaatattattttgaaattggctttaaaataaaaccattcagattgaaattctaattagctcatttgtggagtttgatcacacaattcataatgttgctgctttccattaactagtcttgaaatgcctttgtttgtaaaaataaaataatggtactttcattttataacaaggtgtttttttcaagaaataatccatgctaaaatggatatttgtgatcctgaaatgtttactaagcattgtaaatttatttataactgccatctccaactacatccttatgatgtttttaacaataaaattaaaacaactgttaaactaaaaaccacaccgttttccagtacttgatctctgagctacaatactcactaaatataattttccaatcaaaatattctattctatattctaagggttaatatgtgattatagtgtccacttgccaccatttttttaaatcaatggacttgaaaagtattaatttagatggatgcgcagatataccctcagttcagtcatagattggagtttgcatataataatgtaaatgtatgtcgacactattctaaatagttctattatgactgaaatttaattaaataaaaaaggttgtaaaatgtgatgtgtatgtgtatatactgtatgtgtactttttaaaataggtgtatgtcccaacccttttttatacaggtttgaatttaaaattacatgatatatacatatactttattgttctaaataaagaattttatgcactctca

SEQ ID NO: 10873 - DNA, 1642 bp, Homo sapiens
  ENST00000228280
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatccca

SEQ ID NO: 10874 - DNA, 1948 bp, Homo sapiens
  ENST00000347404
aacagagggagctccgagccctctctggcgcgcgaggtatttcgtctgtccccgggggtgccaggtgagccccagcggatccgggagggtaagctgggactcctcgcgagcagtagctgcagggtaccaagcttcgccctctgcgtccccgcgccttcgcggtctcccgccagtgcaggtccggggcccccaggcgagcggacaaggttggcctaatctgccaaacttctggggcatttaccgtgctctggccgccctcccgattcttccctccgcgcccttgcctgcttctcgcctaccccgggctccggaagggaaggaggcgtgtccggagcaggcgggcgggaactgtataaaagcgccggcggctcagcagccgggcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatccca

SEQ ID NO: 10875 - DNA, 565 bp, Homo sapiens
  ENST00000357116
gcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctaccca

SEQ ID NO: 10876 - DNA, 555 bp, Homo sapiens
  ENST00000552044
ttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaacaaagcagctgctttgaaaagaagctcaaaggattaccttgaaatggttacccactctcccccttttctgctccaagaagaaagtttctttctgtattttcccagcattattaagagtcaagacttgaggccttaagacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtaca

SEQ ID NO: 10877 - DNA, 5191 bp, Homo sapiens; identical to SEQ ID NO: 10872
  ENST00000378535

SEQ ID NO: 10878 - DNA, 1642 bp, Homo sapiens; identical to SEQ ID NO: 10873
  ENST00000228280

SEQ ID NO: 10879 - DNA, 1948 bp, Homo sapiens; identical to SEQ ID NO: 10874
  ENST00000347404

SEQ ID NO: 10880 - DNA, 565 bp, Homo sapiens; identical to SEQ ID NO: 10875
  ENST00000357116

SEQ ID NO: 10881 - DNA, 555 bp, Homo sapiens; identical to SEQ ID NO: 10876
  ENST00000552044

SEQ ID NO: 10882 - DNA, 388 bp, Homo sapiens
  ENST00000568444
ggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctgatgaaaaagttaataaacagaatggcgactccgatgttgagcaagatcaccatgaccaccaggataggcgctgagccctggaagagagcgaggggaagaggtgagcgacagctgcggggggctctgcctgggccaccacgcctcccacccacgtcttttcaccaagctagca

SEQ ID NO: 10883 - DNA, 4572 bp, Homo sapiens
  ENST00000567298
gccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctgcacgtttcctgctcgaaaaccaggagagcctccacgtgccgactagctctgtccacacatccattgcgcagctctgcagcggaaggaccttcagtaaagacgctgcctgaccccagggcctgggagcccccggcagaccggccctccttgccaaacagtggctgccctttatggactcggcgcctggcagagccactgtggaggaggagttggctgtcatggtcaggggaggcagcccttgggttgtcaaggttggtggtcaacgttgaacccatatctgctggaatctcccggtctgttccacacacgatcatgcgggaagctctgggacccgaaggctgttctgatctcgggggtcacaagttctcacagcagcctggggtcaccagggaccagacccggcgttagcctctgtaaggagctgcctggctgctgggctgagctttgttgcaggcccaggaagatgaccaagaaggacagagcagagccccatctaccactgctgggagggcccgagggagcacgtgcacagcagagccccatcctccactccctgggctcgaagaggcttcctcggtgtggatggcagctggagtggacgaggcggacgagtggcagtgaggtaggcatgtgaggttgttgcctggcccactctgccgaccccagaaacccagcggcctgggcccagcacccggctacacatggggctgagccagcaacctccttggcacctggggacagtcgcttcctcagtttctgcgtaccgactgcctcacctgacacgcggcctgggcgcgagagaagccaaccagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctgcttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactg

SEQ ID NO: 10884 - DNA, 343 bp, Homo sapiens
  ENST00000568346
tggcatgggcgcacgagaagggtgtgtctgagacaggatgtttatcccaaatgccaggagtggacgaggcggacgagtggcagtgaggctgagccagcaacctccttggcacctggggacagtcgcttcctcagtttctgcgtaccgactgcctcacctgacacgcggcctgggcgcgagagaagccaaccaggtgcctgagttgactgactccttccgccctccagcttcctccctccgccctccaacctcctccctccaccctccaacctcctccctccgccctccaacctcctccctctgccctgcaacctcctcccctctgccctccaacctcctccct

SEQ ID NO: 10885 - DNA, 445 bp, Homo sapiens
  ENST00000568499
cgaagacagcggagaggagagcggtgcggaggactgaggctgtgacaaaccctgtgcccacgctgcctccactgccgggagactcagggctgggggagacatgccctggtcaccactgcggagactcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattgcgcagctctgcagcggaaggaccttcagtaaagacgctggtttgtaacgagagaagcgttccaaagtgtcacacgacattgtttattactaaaagg

SEQ ID NO: 10886 - DNA, 1287 bp, Homo sapiens
  ENST00000316853
ggtcagtttctccctatggaactactgggcttttagaatgataggaaacctggcctgtccctttacaggtgcgttacagtcaggcgaagctgggctgcgtgaccctgggcagggtgggcggctctcacctgtggagatgcagcactgaggggcccctccagcgtggttgctaacacagactgcctaggagcgtgcttttctcatcctggaccccagctactgcttaatttgcaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaaga

SEQ ID NO: 10887 - DNA, 1663 bp, Homo sapiens
  ENST00000353170
cccggcaagatgggcaagaagggcaagaaggagaagaagggccgcggcgcggagaagacggccgccaagatggagaagaaggtgtctaagcgctcgcggaaggaggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaaga

SEQ ID NO: 10888 - DNA, 1821 bp, Homo sapiens
  ENST00000347925
ctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaaga

SEQ ID NO: 10889 - DNA, 1377 bp, Homo sapiens
  ENST00000566349
agttggtgccggtgctggcgtgtggagggctgactcttggcgtgatgcctgtgcagatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaag

SEQ ID NO: 10890 - DNA, 1886 bp, Homo sapiens
  ENST00000270583
gcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaacaag

SEQ ID NO: 10891 - DNA, 2072 bp, Homo sapiens
  ENST00000569487
tttactgtccacgtgagcatagctgctgtccagggccagcccagcacaggcacagcagtgggtgacagtcccagaaggggatcccccagttggcctcagggtctctgagtgtaccaggtcagccggacccagaaagggccaaggagggctggtcgctgttggttgcaaactcctgaagctgcttttgacgtgtggtggcacctgggctggaaattggaaaaacacgcgggttcgtttctggacccacagtccgcctcgctcttttactttagaaggaattgctccaagcagagtctacacaggtttcccctgtggcttttcttcagagagcgtgttgaccccagctagtgtcacggttctcacactgtgatctcagggccgttgacattccccaggattacggaggacctcagagagctttcccttttgaaactcactgttgcagagtccagacacaaagtggatcttagaagtctagaatgtgaagctgactttgggttgatctggaggtagtgatccttggaaaatttggaaataacctggcaaatgtcacctcgtgagctggcagcgttttgtgacaaaatgacaaaggctgtgacagaagggtccagactgacccctgcgacgcagccagggaagtgggacagagagggatggacagctgtcctgcaggaggcagcctgacctgagagctcccctttaaaaacgtttggtgaggaagggcccctctctggctcgccgtttgtagtaaatgagctgggcttgtgggcctgaccgtctgtcttgcttgggaaaggggaggaagcccctcagcctggcttccccagcccttctgggagccagcactgtgggtgattgggttttcccagggtgagcgtcggagcctgtggggctggtgccctgtgtgtggggtctggtgggcctgtccacctctcagtggaggtgtggagcggcccctcagtgaggacacgcagtggggggttttctgccccagcccaggagtgaacggcgaggctagtgggagacaggagcgtgctcctgcagcccagtgcctgcacccagggcagtcagggatggcgccttcctgggtcacacactccccacgcttgtgggtggtccccgcaaacccttgcctggccttgtgggcatagcaggaatgacccctgcctcgctgaagctgctgctctctgcttcctcggtctattaatagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccaggacgtagccaccaccgtcccgcagcctcccccacctgcctcagctgcgctgacgtgtatgtgcgttcattctgcttttgaagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaac

SEQ ID NO: 10892 - DNA, 1757 bp, Homo sapiens
  ENST00000562155
tctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttg

SEQ ID NO: 10893 - DNA, 1065 bp, Homo sapiens
  ENST00000562261
gagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccc

SEQ ID NO: 10894 - DNA, 2232 bp, Homo sapiens
  ENST00000566661
catttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaagtaaagtatatatttttttcttttcttcccatgttgcgtgagtatcatttgacagaaagttaacttaaggcagtgacatcaaatatgcgttagccccttcaccccttgtatcacgcgcttgagccgtcaggcctgatgtgagacgtcgccaggatgctccaggccctggcatgactgttgatgacttcagtggtcctggggtctctattcctgggacttaggctgaggcccagctctgccgtcatcactcttggcgggcgcacccctctttgtggttgtctgtgctgttcttcctcccagcgggtttccaggtttcacactcagctttcaggttgtcttaaacacggaaagtgctgataaattttagggctaatttttatttttgagcaggccagtaagacctgtgtttcacaattgtgtgtgacacacaaaagcaggagctcaccttccctgcagcccgggatgggccttgggggtttgactgcatttgtccatcttcgtctctcagttttcgtgcatttagaaactaggcttgactgggtacagtggctcatgcctgtaatcccagcactttgggaggccgaggtgggcagatcacctgaggtcaggagtttgagagcagtctggccaatgtggtgaaacccagtctctgctaacgatacaaaaattagcggggtgtggtggcgggcgcctgtagtcctagctacttggaggctgaggcagagaatcacttgcacctgggaggcggaggttgcagtgagcaaagattgcgccattgcactccattgtgggcaacagcgagacttcatctcaaacaaaacaaaaacaaaaaaactaggctggaattaggagaatgaccagtcctaataacaacgagggctttcagtaccttccagattgatgggcctggtgggcgttcggtcgttttcattgtgtcgtcatccccaatggccccggggacccagcccatggcctccctgtgctggtatggtttacattcctttagcatgtcagtttcccagggaattgtcatgattaagattgttctcaccacttccttggaagcgtatcatttgtgacactgacattcttcttccttcctgtagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaag

SEQ ID NO: 10895 - DNA, 875 bp, Homo sapiens
  ENST00000562913
atctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaaggtagtgcaacctctgagtagcatgcgccgtggtgcgcagccctaacttgggtccctgccaccactgccttcctccagcaccttttggtattggggcccccaaagcccatgagctctctcaagaggggcgagggttccgtctctgactgtcctgggtgactaggcttggagagcccttggtcacggtccccttagtctgtcctggatgctggcggggctgctacctcagaagccagttgccctgggctgaggtgcccgggacctccccggccctctgtgtgagaagggtttgctggaggtcctggtgtggaccagcctgtgttatgacccttgagcttccctggtttccgacaccatctttactgtccacgtgagcatagctgctgtccagggccagcccagcacaggcacagcagtgggtgacagtcccagaagggg

SEQ ID NO: 10896 - DNA, 585 bp, Homo sapiens
  ENST00000567513
agctattttgagatctcttcagtctcttgcttgagtgggagttgcctgcaaagctgccccattgcgactttgcagcatagatctccgtactgtttcttatttttgtttctgtgtgtttgttttaaatgtgtgtgcgctcatggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaa

SEQ ID NO: 10897 - DNA, 559 bp, Homo sapiens
  ENST00000562872
atgtgtttcaagatatttctctgtctgttgcttgtctttttattttctaatggtgtatttttgaagttttttatgttggcggagtccagtttataatgttctacctaggaaatctttatgcagtccaaggtcttggagatgttctcctgttttattcttgaggtttgagcttagctagctgggctcttagcaggatggttttggtagttgatagatcagattaaatggtatttaatttgtgagcagtaagtgctcacaaaacagaaatcagtgtaaaaattggattttgtttgttgttgtcgtctttagaacaaccagaaattaagcaggttgatagtgtctttttgtttatttcattttagatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgcc

SEQ ID NO: 10898 - DNA, 562 bp, Homo sapiens
  ENST00000564484
gttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagatgtgactgagcccagtcgaatcacactgattggaggaaagctgagcgggctgtggctccgcggcgggtcctgggaataagtctcacgtgtgcctgcttgcttgccctaggaagacctggaagcgctcatagcccatttccagacactcgatgccaagaggactcagactgtggaacttccgtgccccccaccctcaccaagacttttttgtataacgagctctatgtctacaataccagaaaggacacctggaccaaagttgacatccccagtccacctccgaggcgctgtgctcaccagatcaacaggcggtccttcgggtcggagtggacatcggatggtggcctggaagagacaattgatcctgtttggtggcttccatgaaagtacacgggattacatctactacaacgacgtgt

SEQ ID NO: 10899 - DNA, 582 bp, Homo sapiens
  ENST00000565328
acagatgtgactgagcccagtcgaatcacactgattggaggaaagctgagcgggctgtggctccgcggcgggtcctgggaataagtctcacgtgtgcctgcttgcttgccctaggaagacctggaagcgctcatagcccatttccagacactcgatgccaagaggactcagactgtggaacttccgtgccccccaccctcaccaagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacggaaccagcatggcaattgattgatgtgaaggtgccactcacaccttt

SEQ ID NO: 10900 - DNA, 560 bp, Homo sapiens
  ENST00000569747
acgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcgga

SEQ ID NO: 10901 - DNA, 563 bp, Homo sapiens
  ENST00000564396
acctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacagg

SEQ ID NO: 10902 - DNA, 546 bp, Homo sapiens
  ENST00000568502
agcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagatgtgactgagcccagtcgaatcacactgattggaggaaagctgagcgggctgtggctccgcggcgggtcctgggaataagtctcacgtgtgcctgcttgcttgccctaggaagacctggaagcgctcatagcccatttccagacactcgatgccaagaggactcagactgtggaacttccgtgccccccaccctcaccaagacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagag

SEQ ID NO: 10903 - DNA, 562 bp, Homo sapiens
  ENST00000561825
tttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagcccggggtctgcaggaggatccgtcctgaccttggggttgagtgttctgcggctgctgctcatggattccctaaccggggccagttttatggcctgccgtgcgccaggcacagctccctgggctttactcctcacgagcaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagt

SEQ ID NO: 10904 - DNA, 584 bp, Homo sapiens
  ENST00000568338
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagacctggaagcgctcatagcccatttccagacactcgatgccaagaggactcagactgtggaacttccgtgccccccaccctcaccaagatggaatcttgctctgtcgccaggctggagtgcaatggcatgatctcagctcactgcaacccccaactcccaggttcaagtggttctcctgcctcagcctcccgagtagctgggaccataggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctca

SEQ ID NO: 10905 - DNA, 528 bp, Homo sapiens
  ENST00000563845
acctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagagggcaaataatcatcacagcagccctgagcagtgagcagcagatggttaagtgaagaaggcactggagccacggggtatcccgtagcagctgatggcggccatcacggttgtctccttccctctggtcctcagcccggggtctgcaggaggatccgtcctgaccttggggttgagtgttctgcggctgctgctcatggattccctaaccggggccagttttatggcctgccgtgcgccaggcacagctccctgggctttactcctcacgagcaggaagacctggaagcgctcatagcccatttccagacactcgatgccaagaggactcagactgtggaacttccgtgccccccacc

SEQ ID NO: 10906 - DNA, 564 bp, Homo sapiens
  ENST00000566561
acctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggagagggcaaataatcatcacagcagccctgagcagtgagcagcagatggttaagtgaagaaggcactggagccacggggtatcccgtagcagctgatggcggccatcacggttgtctccttccctctggtcctcagcccggggtctgcaggaggatccgtcctgaccttggggttgagtgttctgcggctgctgctcatggattccctaaccggggccagttttatggcctgccgtgcgccaggcacagctccctgggctttactcctcacgagcagatggagtcctgctctgtcacccagagcaagtgtcgcagtggcatgatctcagctcattgcaacctctgcctcccaggctcaagcaattctcctgcctcagcctcccgagtagtttggga

SEQ ID NO: 10907 - DNA, 1422 bp, Homo sapiens
  ENST00000622456
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagagagttaagaaagacgtggacaagggcacacggcactcagacatgttcctgctgaagccagaggacggaagagaagacaagtgggtttggactcggatgaacccttcgggggtcaagcccaccccacggtctggcttttccgtggccatggccccgaatcaccagacactgttcttcgggggtgtctgtgacgaggaagaggaggagagcctgtcgggcgagttcttcaacgatctgtacttctacgacgccaccaggaaccgttggtttgagggacagctgaagaaactcaggagtggctggaggagacggactcggaagaggacagtgaggaggttgagggcgccgagggtggggtcgacgacgaagacagcggagaggagagcggtgcggaggactgagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttag

SEQ ID NO: 10908 - DNA, 4444 bp, Homo sapiens
  ENST00000446344
gcagatgagcagagtcctgctagagaggtcagctcagcgtccaggagggggcgcctgcccccgaggaggccacggacatgcctgggaagttgctgccggagaagtgtgctctgatgtggctacatttggggacgcgggctccccagaggcccaagcgagaaagccgggggttcccaggctgggggtgcaggacgggccaggcactgccctgcagggcccgcccccctgcccctgcaccctcacacccatcttcctctctcagcctgaccccagggcctgggagcccccggcagaccggccctccttgccaaacagtggctgccctttatggactcggcgcctggcagagccactgtggaggaggagttggctgtcatggtcaggggaggcagcccttgggttgtcaaggttggtggtcaacgttgaacccatatctgctggaatctcccggtctgttccacacacgatcatgcgggaagctctgggacccgaaggctgttctgatctcgggggtcacaagttctcacagcagcctggggtcaccagggaccagacccggcgttagcctctgtaaggagctgcctggctgctgggctgagctttgttgcaggcccaggaagatgaccaagaaggacagagcagagccccatctaccactgctgggagggcccgagggagcacgtgcacagcagagccccatcctccactccctgggctcgaagaggcttcctcggtgtggatggcagctgttaacgagcagtggtggtgcagctggaggcctctgtcccatggggcacagacgggagaaggatggcggacgggtgtgcacgcttgggaggacgggcgggcggcataggcctgagcaggtggcatgggcgcacgagaagggtgtgtctgagacaggatgtttatcccaaatgccaggagtggacgaggcggacgagtggcagtgaggtaggcatgtgaggttgttgcctggcccactctgccgaccccagaaacccagcggcctgggcccagcacccggctacacatggggtgagctcacgcccacactgtggcctgtgcccgtcacggggctgcttgcttctcctaggcttgggaacaagctggcatgaacgctgtggccgcattcacagctcaggcacttccactttgggtttcatgaagaaacagacttaaagagcatttgttcctaatgggtgggctgaagcttgggaggagcattcagcttctctccacagtatggcttcacctgttcctgagcgccctgctaccctcttgctaacctgggtggctgaggtcctctgctttggtggcgttgacttcccgtctgcagccagcgccaggtgccagcccccgcctctgctcatcgggaagcgctggcctgcaggtgctttgtggttgccacggacccttgttctgtccctttccagcacccaccccccacgcgctgtgcattccgtagttcattttcaaggcagggggcacatggtgaaaatacagcctggctttttttcaacaaatgcagctgcactcttccttgcttgttttgaaggctgagccagcaacctccttggcacctggggacagtcgcttcctcagtttctgcgtaccgactgcctcacctgacacgcggcctgggcgcgagagaagccaaccaggtgcctgagttgactgactccttccgccctccagcttcctccctccgccctccaacctcctccctccaccctccaacctcctccctccgccctccaacctcctccctctgccctgcaacctcctcccctctgccctccaacctcctccctccgccctccaatctcctccctctgccctgcatcctcctcccctccgccctccaacctcctccctccgccctccaacctcctccctccgccctccaacctcctccctccgccctctgccctcctccctctgccctccagcgttctccctcctccctccaccctgtttcctccctccacctcttctctcctccctccaccctcttccttctaccctcttccctctgccctcttcttctgccctcctccctccaccctctttcctccctcctccctccaccctctgccctcctccctctaccccctgccctcctccctccgccttatctggaatcggggtcttggtcctgggctggaggcagaccctggcccgggcgaggttaaaggtactgcaggagggcggcatcatgatgtcctgaagcttgttgcgcccggtgctgtcggccggctgaaggcagaaacagtcacagcacctgcagctatggaaggcgacgactgaaaatctaataggcaccttgatgtcaagtttccaagaccaaaggcaagaacagtcagatcaaacttcggaagagtcagagaaagtgagcatgacctagaggagggagacggtccttccgctgtctcctgcagagcgtctgtcgcacgtatgaggtgaaatccgcactgtcccatgaagactgtgaggggagttgccacccgcacacggcccaggagcgccagcagcttggggaccaccacaggcctcagggtctcttcagtccgacgggtccagctgtcgataaaacctcccggggaaggagtaaaggacaaccaagaacctgaactgcaaaagtatgaaaaacatttcatttccctcgagttctccacactttaggtctgcagcgccttgggggtgactgatggccctccgtgagacgcggtggccatgtgcttctacaagtgaaaaggagcaagtgtggttagagcctggagtatggacgtcccggggaccgctggcccatggcctggcttggggccttacaggggagcgagctgagtgaatgcaggggagggcccgtctttctacagtgtgtatcttgtttttgagacagactcactctgtcgtccaggctggagtgcagtggcgcgatctctgctcactgcaacctctgcctcccgggttcaagcgattctcctgcctcagcctcctcagtagctgggattacaggcacctgccaccacgcctggctaatttttgtattttttttttagtagagatggggtttcactatgttggtcaggctggcctcgagctcctgacctcaggtgatccacctgccttggcctcccaaagtgctgggattacaggcatgagccaccgcgcccggccctgccctgcttttctacatcaccactgtcttgtcagttagctcggctcaggcattgcatgcctgatctgtatctttgggaatcctgtgaggtaatggttctagatccaaaagaatggataaagagactgtttcagttcccgaaattatccaggcacattctgtgcgctactgaacttcagaaagcaccagtccatccagtgtgcagaggctggtaagtaaaacaggccagccgtgggcacagacagtttcaccagaggccccggggcagagggtcttctccagctcttccagggcggggctcatctgttcctgggccagaggtggacctgtctgcaggcttgtaagggtggggagacgccagcctggcccatgggctgtccacacccaccccccgcagaccgcgctgctgtctgcaggggatgccaccacttcctcctggcctcgggtgcacaggtgaaacatgaagaagctattggggcggaaaatggctctcaccaggctgctctcgggttaatgaaaactcgtcaaattctccatgcagcagcagccagccgggcacatgctgtcctgccctgcccgactgtgtgcagggaagcaggtcccctgggcctgggcggagggactgcgtgcctgtcagggaaggccgaggctccggacaggcgggaagcagccttctgcttaatcaccccatgtggaaaccaattaaagattcgattctctcagacccggggcattttagccttggttgaatcctcctggaattcacagggaagtggctttgccctctgccctcgctgctggaaggcaaggggccgttctcgccttggttttctaggttgtgttgcggcaggagctgactgcccctaggcctagatctctgcacaacttcgctcagggacacctgcctctgtgcatgtctcatggtgtgaatgtgtttcctgctcacaggtaccgttttgtgtcatgcagttactggaatgtacaaaagcagctgtgatctttgtgagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactgg

SEQ ID NO: 10909 - DNA, 3256 bp, Homo sapiens
  ENST00000371882
ggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtca

SEQ ID NO: 10910 - DNA, 5331 bp, Homo sapiens
  ENST00000371876
cttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 10911 - DNA, 3234 bp, Homo sapiens
  ENST00000371878
gcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 10912 - DNA, 3972 bp, Homo sapiens
  ENST00000262820
attaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtaggtatgttgttgtttcattttcatatgaaacccatctatgttttttcttgctactattggtcagaaatcaggttaataggtgcagaatatagtacagtgctgcagtatccctgttaaggtagaacaatggtattgcaagcttaaaaaaaaaaagcctggctgcttttattaaataaagctgcattgtatggtatgcacagtgcagtcctaaaaaaatatactgcagtcaacgcttttctggcactattgttgagttggaatgattgaatcatcatattgctttaggggacagaagaatttaaggaggtaccttacagccctattttacagattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 10913 - DNA, 2353 bp, Homo sapiens
  ENST00000469946
agagaatttgatgagagagggatccacaagaacatgacaaatgatgagagttcaaaccttaagagaaaaatgggcttattggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataag

SEQ ID NO: 10914 - DNA, 306 bp, Homo sapiens
  ENST00000453826
cattatccaacttttagaggtgatggatcatctgcatagaggggaattggttgctgcaatacttcgtaaccggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaagg

SEQ ID NO: 10915 - DNA, 3322 bp, Homo sapiens
  ENST00000545703
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 10916 - DNA, 3396 bp, Homo sapiens
  ENST00000540167
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtcattatccaacttttagaggtgatggatcatctgcatagaggggaattggttgctgcaatacttcgtaaccgatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 10917 - DNA, 3102 bp, Homo sapiens
  ENST00000541812
tagaagagtgatatttgtgtgagagcctgggtcaggcttattttgagacgtgggccccactgaggtcattatccaacttttagaggtgatggatcatctgcatagaggggaattggttgctgcaatacttcgtaaccgatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 10918 - DNA, 6272 bp, Homo sapiens
  ENST00000328046
gtttcaactcttgcttgaatcaagaacagaagcctctctttagacaggacttatccagagggggctgcaggcgagcactctcgtgccccgccggagcgacccggctcgtgccgggagcggctgctcgtagacgtccgaggagcctgccgagtgccgtcccggcgcccgaccgcccacccatcggcccgctggcccggttcttcctgatgcagactgccgtccactagaggctggacaggaccccccgaggtgattcatggcaggggacgtggaaggattctgttcctccatccacgacaccagtgtctctgctgggttcagagcactgtatgaggagggattgcttcttgatgtcactctggttattgaagatcatcagttccaggcccataaagcactcttggccacccagagtgattacttcagaattatgtttactgcagacatgagggaacgagatcaggacaaaattcatttaaaaggtctaacagctaccggtttcagccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaaaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaagaaaaacctcaccagttttactatcaaagccattggtctaacattgtaagaatttttcattctgtgctagcatcctttttttcttttcagtggcctcaaactcatgcaataagttaattctaagtgctagctcttgaaactacttccagaagcagttgaatagaatgctccacttatctgggatattgattttctgctttaaacatttctttcagatgttagcgtaggagtcatgtgtcttctaagagaagacccgataagtgtcactggatgtgatttcagtctctgtctctatctgaaacctttttgaagatttatttcagtgtatttcagtctgttatactttttagttttattatttaaaagtttaaaactcttgacctttttgcatggctttttgctgaaaatgcaaaaatataaattttctacaaaattaactttttatattcaaaacactatttctaagctgccttctcttatccgcattgtgttagtgaaagcatattcatactcgcatacaacctataaatacacaaggcacatcccttttatgcgtggttaggattctatatttttaagctagtgcacttacttgcacacacagttcgccatacttgttgaattttagatgtaacgtcttttcacatattaacatttttagaaagttgaaataactggagtcctcatttgctatcaaagtagcctatcttcagtccatactgattcagtaatatttgaactccttatatttctgaaacatgtatggttatgaaaactaacactttatattttattttcaaaagtaaatgttagtgttctttgtcgatgtatgtcttttctttttgaaaatgtttttctttgcagtctgtttaacgttaccctgtttttagtgagaatcggagtggtatatgacaagttctggccctgcagcatgcaagcacttttaaagagcatttaggtaataccagactcctaaatcaaggccccttaaaagtaagtgcaactcccattttttacattcagtaaggctgctgcatttgttattgaatggaaggtagaaactcttagaaaatttgacctcagttttgacttagaggtaagaaatagaattataatgttactggttttatctacttgtttattttgtacaaaatacccagcgacactagggatgtaagccctcagtttttgttttatttactgaaagctattagcatgaaggatagtaaccacaaagttcagaatggatcaagaatagctgtttaaaagcatttataataagtgttttaggattagctgcacctttcaactctttaaatgcagaggaaaaaacatagttgacaaagttaagcaagaataacctgggagtggatcattgaaattgatgccatttgcgcatgagtagtctatatctgatacagactagatctatactggcaaaacttgccagatcttagaatattggtgcaatattgcaatgccttctatatggctgctgatgtataaattttctagtttcactttgtttggtgttttttgtttttttgtttgtttgtttgtttttttgctgctgccaccattgaacataaaatggaagtgtgaagtcatggaaatgtgaagactttggtttttgggggttttttgggcagttattagacatactatgagattaaacctgatcttcaaactccagaattggaggcatttgggtttaagaaaccaggtacataagtagcttttgaaaaaaccattggcattgatttcaaaaatcaataataatcttattttatatatgagacttatattttcattaactagtcctgtcatttacttacagtttccaaacatgaaatttggtatcttgtttcccatggtaatatgggtaaaagtctttttctacatttaaaaaatacattattttatttttgaaagttaggaataagttagccatttaatttttttctacattagtttagtggctttgtatgtgtgctattttgctttaaagaaaataacgtcttcattattttcctcattgatgtcttttgctagaaaagaccaagaaagagccatcaggccaggtatccacatcaaagcctttacactatagtggtggttctctttaattgcttagatatgacttcatgaccctagtcagggtgacatctgggcaaacatttgagtattcttggtcttccattttaaagacagaggccaagatcaaagttcatgttttgtaaaattcgtaaaatcttaacttgaactaactctgggttcagctttacgtaagtcacgtcggacctgatgttagctgtaatcagttttgagctttaaggatagttgctgttgcttgggttctgaatgtatgagaaaactccctgtttatatgtagttctaatttaggttattttaaatccatgattaacttacattcccttttaaaattatggttttattgctgcaagagatttatttttgttatactaaactatggaaaagtttttcatagcatttttttcaagtttattttttgtgtgcttcatttggagtttttgtttatatacattgcgctcaaaaaagtagttttttgaaaaattcagtaagatttgaatctatacagtttaactgttatgacctttatgcgtgttgttttcactttatatctcaaatgccagagttcacaaaaatagctgatcttcattaattacatcttaattagaaccatttgttctcttccgtgtctttgaccttctaagttttgattttaaagaaattccttgcactacagccttttcttaaaatgcaagattctcactttgaaggttttgtgttggaagaaatgctactggtttttaaaaagcaaagcttaactaatagaattattagcttttcttgagacagctttctgtgtcctcattactctgctctgtgtgagtgttactagaatttgtgaaatactgactgagcccttcacttatcttttctaaagcagcacctttggacacctcattctgggaagcctgctcgagtcatagtaaaggacacacgctttatgtggggagaagtggtaaaaatggagttttgtcttaattacatgaaactaagctttaaaatattttataacagattatttgagctgcataatctaaacatgtcaaacgttcagtgggactatttttatatatgtatatgtgggtgtaggtcataacatttcagtttataatataaattgttatttcagtttataagctatctctcagaggagactagctcttttgagaattcataatttaaagttttagactgaagtaaaatgcaacatagataatagtgtaaatcagatataattgagggctatatggcagtaaaactgctagtgccagttttcttgtttgcctgttatacatttttgatttttgtttttgtattctgaacattttgagagatcatatgtttgttcaattacatttagagttggtttgggaataaatatcttctaaaaagagatttatcttaaaaatggaagtcctaaaaattagtttatccagagtttataaagtcaaatattcagtaggcatagactggaatagataaattcatggaaatcatatcctttcagtacaccgtataacttcaatattacacaagtaacattgaggagaatgccatcagctttgttctcccttaaattctttggttttctttttacattttgggaacaactgcatttaaaatgttattagtcagtatatagtaaggattaggtgtttgctttctgaaggaatggtccagtgaggtgattgggagaggttattttctacctaacttgtatatgccctatacctcttgggcatactttgtctatagaaaaatattttgacctttaggtacattttgggccagtagtcaaataatcctagggccgatataaaaatcttagaataatttaaggtttgccttttatacctgttttgaaagcctttacatttttgtcaggtaatttttcccaagccgtggatataatctattcaaacatgtttatgctatccattctgtttttaaattgaaaaaaatgttaaaagtgtttatgaagaaaagtttaaataaaatatttttaatctttaaaa

SEQ ID NO: 10919 - DNA, 2616 bp, Homo sapiens
  ENST00000328879
acgtgacggcccaggcccccgccccgccggctcctctcgcccagcctcccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtt

SEQ ID NO: 10920 - DNA, 596 bp, Homo sapiens
  ENST00000487090
tttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggagctggggaagcagcagttctccagcttggccacagaggggcagccttggctttcaaccagctgcatcgtggctgccggtgttccttcatgcacgcattcattccgcaactactaagcaccatgtaccaagtcctgggaatccagtggtgacaagaaatgagaaagactccccactccatggtgtttacagccttgtaggagaaaccactcttaaccagaaaacagatcagtaaagtggttacaattatggt

SEQ ID NO: 10921 - DNA, 1389 bp, Homo sapiens
  ENST00000479601
tgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggcttcgggggcattcactccacgccgtccactgtcctcagcgaccaggccaagtatctaaaccccttactgggagagtggaagcacttcactgcctccctggccccccgcatgtccaaccagggcatcgcggtgctcaacaacttcgtatacttgattggaggggacaacaatgtccaaggatttcgagcagagtcccgatgctggaggtatgacccacggcacaaccgctggttccagatccagtccctgcagcaggagcacgccgacctgtccgtgtgtgttgtaggcaggtacatctacgctgtggcgggccgtgactaccacaatgacctgaatgctgtggagcgctacgaccctgccaccaactcctgggcatacgtggccccactcaagagggaggtaaggaagccctcgaag

SEQ ID NO: 10922 - DNA, 724 bp, Homo sapiens
  ENST00000451553
tccctccagctgcgagtgcggcctcggctggcggcggcaccagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggaccccagccctttgagggacacagtggccagcgccctcatgtaccaccggaacgagagcctacagcccagcctgcagagcccgcaaacggagctgcggtcggacttccagtgcgttgtgggctt

SEQ ID NO: 10923 - DNA, 1045 bp, Homo sapiens
  ENST00000444967
tccagctgcgagtgcggcctcggctggcggcggcaccagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcacgagcccccaaagctccttgagacagtgcggtttccgctgatggaagctgaggtcctgcagcggctgcatgacaagctggacccca

SEQ ID NO: 10924 - DNA, 742 bp, Homo sapiens
  ENST00000458248
agctgcgagtgcggcctcggctggcggcggcaccaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggcccttctctaccattatagcctggagcaggtgcaggctgaccagatctcgctgcac

SEQ ID NO: 10925 - DNA, 792 bp, Homo sapiens
  ENST00000443285
agctgcgagtgcggcctcggctggcggcggcaccagtatgggtttagggagtagctgccatttatcccttcccaagagagcagaggcactactatgctcacggaaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccattggagaaggtctactccctcctcagcagcaatcgcctggaggtctcctgcgagaccgaggtatatgagggggccct

SEQ ID NO: 10926 - DNA, 550 bp, Homo sapiens
  ENST00000494929
ctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagatgctgttcaccagcccaggcttgaatgggtgtcattctctctgcagatcccagaaattatccatttctgctgtgatttcctcatgtcctgggtggacgaagagaacattctcgatgtctaccggctggcagagctgtttgacttgagccgcctgactgagcaactggacacctatatcctcaaaaactttgtggccttctctcggactgacaagtaccgccagcttccatt

SEQ ID NO: 10927 - DNA, 572 bp, Homo sapiens
  ENST00000431430
tcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcagatgctgttcaccagcccaggcttgaatgggtgtcattctctctgcagatcccagaaattatccatttctgctgtgatttcct

SEQ ID NO: 10928 - DNA, 824 bp, Homo sapiens
  ENST00000470335
cccagcctcccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcagcatgagcttcaccactcgctctaccttctccaccaactactggtccctgggctctgtccaggctcccagctatggcgcctggctggtcagcagcgtggccagcgtctatgcaggcaccgagggctctggttcctggatcttcgtgtcccgctccaccagcttccagggctgcatggggtctgggggcctggccgcggggatggctggggatctggcaggaatgggaagcatccagaatgagaaggagaccatacaaagcctgaatgaccgcctggcctcctacctggacagagcgaggagcctggagaccgagaaccggaagctggagagcaaaatccagaagcacttggagaagaagggacccagatcagagactggaggcattacttcaagaccatcgaggacctgagggctcagatctttgcaaatactgtggacaacgcccgtatctttctgtagatcgacaatgcccgtcttgc

SEQ ID NO: 10929 - DNA, 708 bp, Homo sapiens
  ENST00000490556
gagaggtcagaaaagggagaattatcatagagcagagtttccaggcaagagaatcctaagtgagaggtggtcatggggtatacaccttggctgtggccatctctggggccttggtgagaaagatgagccagcccaggagggggaaaggaatgggtgggtggctggatagaggtcccaggtcctggaggcagactcaggggcagacacatcgaggcccatcgcatcctgctggctgcgtcctgcgattacttcaggtgagttcactagagctgtttgtaagaagaataacaaaggtaatcctggctctgctagtaaaggtactggcggtgacagtggctggtctcctgctcacctcagagcctcccctactccttgtggctatgacttagtcaacaagtgtgagagacagaagggggtcttagagttcatttttcattcagtgatcctgtttcttgggctttgcctcctcttctcttccctctcttctcttccttttcttttccttttctctctcttttcttttctcttttctttcctcctttctctcctcccctcccttaccattcctcccctccgtcagtaattattgctgtgtatgcatcaccttctggctcacacctctcatccctcaggtgttagcctctggccctcccagtgagctctgtggcccctctggggtttcttatggcctccttcgtgaccccatcc

SEQ ID NO: 10930 - DNA, 769 bp, Homo sapiens
  ENST00000423364
gtactgtgatattgtgaaatatatatttggtcttgtctcatttcttggcatacaacttctaaaatctttggactttccagagtgatgcctttttgtatgctggccagcagcccctaggtagcttcaggatgggggctggtgacaggaaaggccaaggcaggcataagagggttgggactttcagcctcacctctcaacctccggagaggggagacaggctgaagattaagttcatcaccaatggccagtgatttaatcagtcatgcctacataatgaagcttccataaaaattctgaatgactgggtttggaaaacttctggatagttgaacacatggaggctcctaaagagtgatgttcctggagagggcctggaagctctgcaccacttcccacatgtctggccccatgcatctcttcatcttaaaggaaagtaggccctggaaatgccacccccttggcacccacctcccagactcctggctgtgtgtctcctgaccactactcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcag

SEQ ID NO: 10931 - DNA, 3425 bp, Homo sapiens
  ENST00000261425
ctcccgcctggccgccccggcccgccgtgacccacggccgcctccggagcccgacgcgcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtca

SEQ ID NO: 10932 - DNA, 2926 bp, Homo sapiens
  ENST00000508137
ccgccgtgacccacggccgcctccggagcccgacgcggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtc

SEQ ID NO: 10933 - DNA, 2690 bp, Homo sapiens
  ENST00000504108
actgcaacggggatagtgttttctgtctctgtcatttgtggtttaagaaaaagggggtggtgttctgcatttgaaaggactttaatgaatgctgtcagtgtttgtgagacctaatggtcagtatgggaaaggagagccgggaaagtggtctagctgcttcaggataggtggatgagagtttgctctgattgaacggaatgttccaccgtgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagata

SEQ ID NO: 10934 - DNA, 3288 bp, Homo sapiens
  ENST00000381930
tgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtatggcattcatgtttcattattacactgactctctttttattaaaacaattcttatggtaaaacagatcccctcaatcttgtccaatactgaaatatatggcataaatatgacaatcacgttttgattagcgatgagaaaaagaggcaatgtttaattttataacataattaaaatccagaattacctttgagatgtaagttaatactcagagaaattattaattatctgctaccacttgcatgatgaagtgttctagcctgattaaagctgataggactactggagggctgcaacaatgggaggggagactggaaaataaaaacaaggatagtagtcagaaaactttgaacaacttgcccatgtgtgagcagtcggatttttaaatactcaacccattgatatctgggagcagattaaagtcctgataacctaatgaagatggcaaccctaaattacactgagtaagaaacctgatctggcagtcttactaacagaaagaatttcacccttgtgtatttctgggagggtctagcacttctaaaaatgatcttttgagatctttgcttccatcatcaccaagaacagaatcaggaatttgtgcttgtgtcacccagttcagtacttggtacataaaagacaataaatgtttaactgagccaagattttcttgtatacaaggagccatgataagtatggtcaagaaaacaaagcttctaggccaggcatggtggcttatgcctataatcccagcactttgggaggctgaggcgggcagatcacgaggtcaggagttcaagaccagcctgaccaatatggtgagaccccatctctactaaaaatacaaaaaaattagccgggcatggtggcacgtgcctgtaatcccagctactcggggggctgaggcaggagaatcgcttgaacccaggaggcagaggttgcagtgagcagagatcatgccactgcacttcagcctgggtgacagagtgagactccatctt

SEQ ID NO: 10935 - DNA, 3300 bp, Homo sapiens
  ENST00000261426
tgtttcatctttattcattatcctttgttctttaaaatctgatatattggcataaaagtaattgtagatatatatatgaatgtgatttattttcctttacatatttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataag

SEQ ID NO: 10936 - DNA, 585 bp, Homo sapiens
  ENST00000514399
agcagaagattgtggcggtgcacattggctggatagaccagaagtggatgatggcactagtgaagaagaaaatgaatctgattccagttcatgcagctctccagactaatatagagaatactaagtaacatgtctctaagatgacagctactaattcctgttaccttcactttcactgaaatgtgtgctatttagggaaatgaaggacattcctccaggagagtttaagggaatgtagaggggctagatgtgattatctggtgaaaaggggacaggaagaaggggaaatcagttagaagaaagaaaataaggaaaaaaataggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataa

SEQ ID NO: 10937 - DNA, 909 bp, Homo sapiens
  ENST00000515612
ccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaatactgtggaggcttatgatccccagacaaatgagtggacccaggtattttcacatacttttgaggacagcaaagatcacctggtggccatcaagcagaccatctggaggcaaaactccttatctgaggaattcagaagtcattagactgccctattatctaaagccggcatcttgtactaggcttctttaccaaaaatgtatttaat

SEQ ID NO: 10938 - DNA, 1708 bp, Homo sapiens
  ENST00000376851
agacccaggagtccaggccctcactgcactcagggaccagtgctcccttccctggaggcctggtcaggggtcaccaagagcagagcgtgggggcgggaggaatgtgtgtgggaggcctgggtaaggaggaaaagggtgtagccagtctcctggctcagggacctgagagacaggggttaaaaggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatga

SEQ ID NO: 10939 - DNA, 1511 bp, Homo sapiens
  ENST00000310157
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatga

SEQ ID NO: 10940 - DNA, 1353 bp, Homo sapiens
  ENST00000597379
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggagcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 10941 - DNA, 842 bp, Homo sapiens
  ENST00000594641
aggagaggatgcagagggagcagacagagggatggggggagggtcgaggcagtgactaatggaccatgtggcttcccctctcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgaca

SEQ ID NO: 10942 - DNA, 819 bp, Homo sapiens
  ENST00000599881
acagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctga

SEQ ID NO: 10943 - DNA, 928 bp, Homo sapiens
  ENST00000599690
acagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctga

SEQ ID NO: 10944 - DNA, 1478 bp, Homo sapiens
  ENST00000391808
aggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 10945 - DNA, 6793 bp, Homo sapiens
  ENST00000304613
ggtgcgcggcgcggccgcaggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagacgagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctccctggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagatctacaggcggagcctctgcgtcctgcaggcctgggtggaggactgctacgctgtggacttccctcggaacagcgggctgctggggaagctagaggacttcatctcctccaagatcctacccctggacggctctgccaagcacctgctgggcctcctggaggtgggcatggaccggcgggccgagggcaaccctcgcggcacagacctggagaaccccagggaggccgaggaggatgccagacccttcaacgccctctgtaagaggctctcagaggacggcatctccaggaagagcttcccctggaggctgccccgaggcaacgggctggtgctgccgccacacaaggagcgcccctacaccattgctgccgccctgcccaagccctgcttcctcgaggacttctacggcccctgcgccaagaccagtgagaaggggccctacttcctgacggagtacagcactcaccagctcttcagccagctcacgctgctacagcaggagttgtttcaaaagtgccacccggtccacttcctgaactcacgggccctgggcgtcatggacaagagcactgccatccccaaagccagctcttctgagtctctttcggccaaaacctgcagcttatttctgcccaattacgttcaggacaagtatctgttacagcttctaagaaacgcagatgacgtcagcacctgggtggctgcagagattgtgaccagccacacctccaagctgcaggtgaacttgctgtccaaatttttgctgattgcaaaatcttgctatgagcagagaaacttcgcgacagccatgcagatcctgagcgggctggagcacctggccgtgaggcagtcccctgcctggagaattctgcctgcaaagatagcagaggtcatggaggagctgaaagccgtggaggtcttcctgaagagcgacagcctgtgtctgatggaagggcggcgcttccgggcgcagcccaccctgccctcggcccacctcctggccatgcacatccagcagctggagacaggcggcttcaccatgaccaacggggcccacaggtggagcaagctcaggaacatcgcaaaggtggtgagccaggtgcacgcgttccaggagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctgggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcctccccagcccagacccccaggtgcccaaggcctgctgctggagcaggcaccttgggctgggcctgctcccccagggcccagggccccccagcttagaacagcccttggtgaggtggtcatgcccgggcaaaggccctgcttcctggaaaggacactcagagcagctccaagacagaggctctgtggcgggggtccctgagagtgcccccacccatctcatgccccagggaccgccactgcccaccgcctccagcagccatgcatgtgcgcccgcagccctgcctccacagctcgccacacactcacgcttcgccagagacaggaagtgcgctgcctccacggccccttgcccttgctcaggttcttggaccccaggcagctggtgtggagccccttggccagggccatgggagtcccgcgcagtcagctccacattggcctctgcagctgggtgaccagagccccgggcacggccccagctccgtggggctctcacggtgccaatcacaagacccagggttgtgcttttgagttttagaattagtcattctttagagcagccagctagtggcatttctaggaaaactgtgacctgtgacaaatcgctgcatttttaatgtcaagatgtgttttcccacataaattcaccggagacatccgggccccgcttcgatgtaacatgagaggaagtcggcgtcctggccacgaaatgcagttcacttttttttaggcttttatatggattatgttttgctgacccacgcccgcattttcagattttgtatctaacagacagtgctcagtgcaaatcaacattccagcggtcaggactgaccccggggcagcactgggctcaggcttcagcgcgactgtccgcatggctccctcccgtcctggcaccaatttctgaataaagtcctttctaccagc

SEQ ID NO: 10946 - DNA, 639 bp, Homo sapiens
  ENST00000478074
cgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagcctccaccccatgaggctcccctctccaccccgctgccctgagcaccaatgggctccagtggcccggcctggaagactccgacccctcccccatcgctggcctgtttgcttggcattcatccacgacatgcaggcttagcaagcgtctgggctcacagacagcagggtgagtggggtcctgcctcttgctggttctggtctacacaagtgacagacttgatgtgagacccacaggctggggatccaataatgctgggacatgagaatggggccccaaggctcttgtttgcatcagaggcctccagaggccactg

SEQ ID NO: 10947 - DNA, 438 bp, Homo sapiens
  ENST00000485110
cgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagagccctggccagtgaggccctgtctgggcccaggcggtcctgggagcccccaggtgcgtgttcacagtgtcctcctgaggcccgggctgtggtggacccaccacgctgagtgc

SEQ ID NO: 10948 - DNA, 643 bp, Homo sapiens
  ENST00000530127
aacaggtcttaggtggtccctgctctcagacctaccccatggctcacccaggcacgccctgctagggatggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagccgtcagcagccaccatgaatcctgcgagccgccacagtagtcctcaccttggttcgtgagcagggctcccgctctcaggagagccgccctcatcgacgctgggcagccgcagcagacagtccctgtggacagagaggtgggaggctcgactccttctcttcatccacctgttttcaaagcagtgagtgcatccagcgtcctccaacgtggaccagtgagcttggttttatgatcttatgaatttaagattcgcacgtctttgatgggattttgtctgttctgctgattccacctgaagctcagaaggcaccccg

SEQ ID NO: 10949 - DNA, 3925 bp, Homo sapiens
  ENST00000368571
gttccgtggctctgacgtccagggaacagcaggacgactcttgaaacaaaatgagacgtggtctaaagccctttccctgacccacgcgttgaaacgctgccacgagtcgtccgtttccccagggaatcgtctcggtgggggtgccggggcctggctgggggtcctgccgggctcacggccagggccggtcttggcaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagacgagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctccctggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggcaagtgggctccgggccccgctctgccccgtgaggcagtagcttcagacgggcctcccactgttggatgctgtaaatctgtccgtgtgaagttataaaaggggccctgatttgagggtccaatgccaggaagccctggggcgaggggcagagtgaccaagcgcccgtgtcccgctccggcaggtcatgtacgcggaacgctggggcctggagccctgcaccctcccagtgatcgtgaacatcgcggccgc

SEQ ID NO: 10950 - DNA, 6432 bp, Homo sapiens
  ENST00000219837
ggccggcgactcgaagtggacttccgggtcacggcggagctggctctcacgtggaggcggggaaatttcgcccaccggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaaactccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtaagtctcatgtggaagttgccatggttttgtttttctttctttttttttttttgagacagtctcactctcactccacgcccaggctggagtgcagaggcgtgatctcagctcactgcaacctccacctccagggttcaagcgattctcctgcctcagcctcctgagaagctgggattacaggtgagcaccaccacacccagctaatttttttttgtatttttagtagagatggagtttcaccatgttggccaggatggtcttgatctcttggcctcatgatccacctacctcagcctcccaaagtgttggtattacaggcatgagccaccgcacccaggccccatcatttttattttctacaattctggctgacatcttattgctccatccttgctaatgatagacttcatctcacatagaccagtgttttcagagaccggcttattgattcagtaaagggctgggggaaactgcacacacaaggacatataaaatctaagcctctgcctgggccacatgacaggattcagaagcacctttgatataatgggtgcccgacctcatgtgaaagtccaagttcaggtgtaatgtgagagcggtaagaattcactggcctaggcttgggaactaatgctgcccaccacgttcagcctcagaggagaagaaatgacttgaagaacataatttgtgaatttgccaattgtttttcattttatagcatcacacagtaaaagtagataaaataattttaatgaaaatacttctgtgggccaggtgcggtggcttacgcctgtaatcccagcactttgggaggccgaggcggcggatcacctgaggtcaggagttctagaccagcctgaccaacatggagaaaccccatctctactaaaaatacaaaattagctgggtgtggtggcgcactcctgttatcccagctactcaggaggctgaggcaggagaattgcttagactcgggaggcggaggttggggtgagccgagatcacgccattgtactccagcctgggcaacaagagtgaaactgtctcaaaaaaaagaaaaaaaaacagaattttgtgaaataaaggccacttgggagtatctgagccaccccacaa

SEQ ID NO: 10951 - DNA, 1311 bp, Homo sapiens
  ENST00000568230
cacagcagcccacccagtccagcaaatgcacatgtgttgcaggcctggatgagtgatgggaatggagagggcttccagggtcatcacacacgtgacgctaggtgccaggcacagcacacttctcaagtgaggacgcatgaaatgtcagcatttgtcgttactgaagaaccccaagaaagtggccggcctgaggtctcgctgttggagggtgtcttcagggccaaggcgggtgggagagcatggtgcatgttagtgtggtccttggcctctgtcctgtagtttggtgtcaccgtaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagcca

SEQ ID NO: 10952 - DNA, 595 bp, Homo sapiens
  ENST00000567367
ggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactg

SEQ ID NO: 10953 - DNA, 1394 bp, Homo sapiens
  ENST00000565844
gggccggcgactcgaagtggacttccgggtcacggcggagctggctctcacgtggaggcggggaaatttcgcccaccggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacggtaagtttggggctagggctctgcgaggaggtggcacgctcggcctcccgacgcttcccctcgcctccagcatgaggagtggagcaggagaaccaagtatgtccaggccccagaggcagccctagcctgcagcaggctccctccacagcagaatttgtcctgagctaatttccttccttctgaaaagggcgcttgcctccctcctagagagctggcccggtgagataagctgcctgaacctttgtctca

SEQ ID NO: 10954 - DNA, 1020 bp, Homo sapiens
  ENST00000564480
ggccggcgcggggtgtggagattgcaccagaggaagtgcgcggcggggaagatggggaaatgcggtccacccacatccctgaatccgacccctccagtcggtgtgcgcccgctccggcctgaggccgccgcctccagaaagttttcccgcctcagagccggccctgggaccccacgtaatccctcccagtctgttgatgcggaggcttgggcccatgggagccttggaggtacggatcttacttcctggctcccgcgcgtcctgctggtgatcctgccgggggagtggggtgttgctgcacaggctttggagtcctgtgggcggaattccagtctccgttttccacttgctggctttggaacctagggcaagtgaattattgtagtctctggagcttgcgaggtcgggtattcacaaagatcttcacaaggctgtccctggaatttaaaagcggttttggagaaagcgtttgcgtttgcaggagatgcactgtaacgttcttttcctttctccttgaaagagtgaatgcatttggtcgcagggctaaagaggaggatgctatacttttctaaatggcaagagatggggagagaaggggattaagagttgacccgcaacctcccggtggattctttgttcttaccagatctcttggccactcccctattctgaagtcgtcttggctctcttgactgctcccctattctgaagtcgtcttggctctcttgactgctcccctattctgaagtcgtcttggctctcctgactacactatttcaaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgag

SEQ ID NO: 10955 - DNA, 331 bp, Homo sapiens
  ENST00000535410
gccaatttaagcctgtggcatggaacctaaagactagaggcggttgtgtgagtcaggaagaggggccagatatctgagtgttcctctttagtttcttcaattgcaggagagaggttggagtcggtttttgctggcggcgatgtccagcggagagcgtttaagtatggaggcctaactgacaagtgtttcatcttgctcattctctcgtattcgcgaatctgttctgcattccgccgccagagtgatctcaaaattataaaatcagaccactcgtttgctgagttccccttctaccccttgtactgagaataaaattcaatcttgaggtcga

SEQ ID NO: 10956 - DNA, 3655 bp, Homo sapiens
  ENST00000450485
caatttaagcctgtggcatggaacctaaagactagaggcggttgtgtgagtcaggaagaggggccagatatctgagtgttcctctttagtttcttcaattgcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagcta

SEQ ID NO: 10957 - DNA, 6975 bp, Homo sapiens
  ENST00000333479
caatttaagcctgtggcatggaacctaaagactagaggcggttgtgtgagtcaggaagaggggccagatatctgagtgttcctctttagtttcttcaattgcagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagttacaaggacaaatcaagtccagttttatttctactgaaaattatcatactcttggttgtctcagtcttgtggctggagatttagcaagtgaagttcctgtgataattgggggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaa

SEQ ID NO: 10958 - DNA, 553 bp, Homo sapiens
  ENST00000535186
aacccgctcgggtccccttccacactgtgctttgttctttagctgtttgcaataatcttgctactgctcactctttgggtccacgctgtttttatgagctgtgagactcacatgaagatctgcagcttctttcctgagtggagaccacgagcccaccgagaggaaggaacaactccagacgctctgccttaagagctgtaacactcactgcgaaggtctgcagcttcactcctgagccagcgagaccacgaacccaccagaaggaagaaactcccaacacatctgaacatcagaaggaacaaactccagacgcgccaccttaagagctgtaacactcacctcgggggtccgcggcttcattcttgaaatttcttttcaaccagttttcaggcaacattttctcaccaagaaagacctcattaaagctcttgtggagaatatagatatggacacaagcctcattttggaatattgcaggcattgagtattctgaaacatttgaagtcatacagaagaatttctcctcccgtggatctagaatatcagtatatgt

SEQ ID NO: 10959 - DNA, 1250 bp, Homo sapiens
  ENST00000423927
accacgcccggctaattttttgtattttagtagagacagggtttcactgtattggccaggatggtctcccatctcttgacctcgtgatccgcccacgtcggcctcccaaagtgctgggattacagacatgagctaccgcgcccagccttgagctttatttttgacattgtaaaagaacagacaagcaggcagggcgcaatcttgtctttgacaggatctcattctgtcacccaggctggagtgcagtggcattatcatggctcactgcagccttgacctctagggcctaagtgatcctcccagcttagcctcctgagtagctgggactacaggcatgcaccaccatgcccagctaattgttttgtatttttttgtagagacaaggtttccatgttggccaagctggtctcaaactcctgacctcaagtgatccacccgcctcagcctcccacagtgctgggattataggcatgagccaaaaccctgttttctttaccaaaaatataagacattttatttgccaacagttgacttatcagaaaggtaatcagtacagaaatgctatatgttttgaagcttaattcttctgcagtaatggaactggtgttctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataacc

SEQ ID NO: 10960 - DNA, 782 bp, Homo sapiens
  ENST00000545065
aaaaatataagacattttatttgccaacagttgacttatcagaaaggtaatcagtacagaaatgctatatgttttgaagcttaattcttctgcagtaatggaactggtgttctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggtgatttaaataacctctcctgctgtcgaagagtatgaagtcactacagaactaattgtgaagaattaaggaaacatttgccatgtaggaagtgaaaaagg

SEQ ID NO: 10961 - DNA, 1519 bp, Homo sapiens
  ENST00000377192
ttttttttttttttttttttttttgagatggagccttgctctgttgcccaaactggagtgcagtggtgcgatcttggctcaccgcaacctccacctcccgggttcaagcaattctcctgcctcagcttcccgagtagctgggactacagccatgcgccaccatgcctggctaatttttgtatttttagtagagatggggtttcactatgttggccaggctggtctcaaactcctgacctcgtgatctgttcaccttggcctcccaaagtgctgggattacaggtgtgagccactgcacccggcctaatatctgatttttaaaaggcaataattagctttgatgacaggtagtttgtctgattttgagactggacaatgacaaggttaaatttcaacaatggaagcatgtacccaagtgttttgtcagatactttgcatggaaatgcctgcagtttgggagactggtgtgtattgaatgcttcttttagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctg

SEQ ID NO: 10962 - DNA, 2412 bp, Homo sapiens
  ENST00000436959
tatagtttagatgaataatgttaaagagaatactagaaaaggttttgatcctctttctgaaaacaagatggtctcaggaatggaaacttttgatggtatactattagatgattttatgacagtttaggattgggttactcttactggacaaaagttttttattttaatataggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcagagatggaggtcttgctatgttgcctaggctggtcttagaactcctgagctgaaacaatcctcctgccttggcctcccaaagtactgggattacaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaa

SEQ ID NO: 10963 - DNA, 616 bp, Homo sapiens
  ENST00000541466
ttctagctacagaactcagtgaagaatctttcccaacattgctcttaatttcgaaattaatgaaggtaatggattaaaacattgtaagacatttctgtatcctgcaattaattctgaccccgtatagaagatttttctgctgctttcatgtaaaaccttatatgtgaatatgtgcttcagccataaccttccttttctttgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtga

SEQ ID NO: 10964 - DNA, 624 bp, Homo sapiens
  ENST00000546125
aaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaacagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgct

SEQ ID NO: 10965 - DNA, 1178 bp, Homo sapiens
  ENST00000536625
tgagtaaacaaatatgagtagacccatcagttaagcaaaaatcttttcataatttatgttataatttttcaatgtaaacataatatcgtatattaggttttttatctaatagattttcagagagatgaatgtttgtttagtcataaactttttcagtttttgacctttttttcctaccttttcaaagaaaccatcagaattatttgaacttcaagaagatgaagccctacgaagagtgcagtatctcctcctgtctcgtccaattgattatagttcaagaatgctgtttgtatttgcaacatcaactacaaccgtaagctctagaaacttaatccaaactcttctgtgcatctcagcttaacatttttttcctgtttatttaccatgcttgattgcattaacagatgattcagataatgctcacgtacatatgtattcaaagtctgtctcatctcctaagcaagcattgtcttgcaccatgctccatttagttctggtctctgtaacatctgcttagcgtgctgaatggtgcacctattgacagtttccactggctgtctgcattcacagtggttaactccctggtcagtccacattcctgaagccaggagccaaacaaactgtccacaaacaagtctccaccaaggcctaatctggctgcatgctctggtcagaccaccccttctgcccactaaattctagctagattgaacttgcaatttcccctaacggcaatatgacctttagcttcaggttcttgcctatagaaatgtcctctgaggcagttggagcagagagaggagaaggggatggagccagtaggcaaatgattctcagagaaaaggaagaaaaggaagtctgaggtgctgattttaaagtccgtgacaaaaaggaaaaagcctccccttatattctctacatataaagacttacgacctaaaaatggtattccatgaaaggtggctagtgcagctcacagctcagctgtgtacatgcttttctttgcagtctgccttatgtgtacttcccattaattagtattagcatgtattcaaatgggaattcacattagtatgatatacagtaatctttccgtatctgtgggaggactggttccaggacccccaaggataccaaaatctgaggacgctcaagtctttcatataaaacggtgtcat

SEQ ID NO: 10966 - DNA, 203 bp, Homo sapiens
  ENST00000542727
ttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactt

SEQ ID NO: 10967 - DNA, 615 bp, Homo sapiens
  ENST00000539013
atgaaaacagctttgaccctttccctcttgaaggagtctcaggaatgccccttcaggggtccatggaccacatgttaagaaccactgttacacacagtgcgttccgtaactgtagagattgactttacattttaaaataatgacgttgtttatgttgcctatgttgaaactcatttacccaactacaatgtgcaggtgttcaactctccaaacctcttttggtttttcagacattaggtatgcatcagttaacttttgcccatagaactcgagctcttcagtgtctcttctatttggctgacaaggaaactatagaatctctctttaaaaaacccattgaagaagtgaacagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcag

SEQ ID NO: 10968 - DNA, 641 bp, Homo sapiens
  ENST00000541427
atttatcttgttcaaattgatttctatctaatgttattatatattcagtgaatatatttggaagtccaaaatggacatttaaaacaaactggcctaatatttccatatggtagtttttattttaaatgtaaatgtggcctatgagaatgattcttagaaacgtttctgttttccagatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagtt

SEQ ID NO: 10969 - DNA, 1065 bp, Homo sapiens
  ENST00000534995
gcctgtaatcccagctactcaggaagctgaggagggagaatcacttgaacccgggaggtgttggttgcagtgagctaagatcatgccatcgtactccagcctgggtgacagagctagactgtttctcaaaaaaaaaaaaaaaaaaggttttgagtcttctgagaatttagaagcctatctttaggcatctgtaggctttcagacataatcatgatagcaaacagtagtccgtgttcccatgggtaaattcttttattctgtgtagagtgctgtcaaagacttgtgttactcattcctaagcatatgtcatgcaccagcactttagtgtttaaaattattgaaaacttggacaggcagatgactatggaaagctagaaaggccaatataatctagtgaatctgccagattattaactaattaatgttctctctcgaagatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatga

SEQ ID NO: 10970 - DNA, 2764 bp, Homo sapiens
  ENST00000394049
gcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagtacagtctctttctttatattctcccaatagtcttctttttcccttgaaacttcatcagagactgtaagcattaacctggtttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccaccaaaaaaagaaaaaaaatcagaaggccaactgcgcaaacaaaacatgaaaagcaaattgaaaaggtagttactatagttatcagaacagttacccaccatcccagtttttccaactgtaaagctaaatgtgattagattgtttgctataagccgtagataagatactatatgaagtattataaatatttcttgcaatcatttatgtgaactaagataacggtattgttatctaagctaagagtatttagaggatttgtttttaaatcgttcaaattgtaataaatatgggtagaaaatatatttgtgaataagtgaggtattgttgcaaagtttttaaaataacctaatttgtttaatacaggtatatttaagatcttaataaatacctgttttaagacattagaaatttataagttcttaattcttttctaagcagaaaaagtagctgagtacaactcaccatactttttcccagctaaagtatcatctaagggctatagctacgttagcattttagtacagcctttaaaatatttctctctctctctcctctctcttctcctctatctctctctccatatatacttattatatatatacatatatataatttatatatatgtatatatatatttcaaccagaaaaatgtatgttttaaccaggaaaatattatgttaaataatctttaacataatacagggatataaaatttttaattttctttcaattacttcagattccttttagtctggtttattctatttagtgaaaagggatgattttgttttgtcaaggatataacagcatgttaagtgcttattcttgcataagcatctgacctaaaatacatcctatacataaaaaatgtttcatttgatattgctaaatgctactaactttattaaagctttaaaaatgcaatcatataagctattgtactaaagttactgtactaagcaacagtgatcataataaagcaatatatctagcataa

SEQ ID NO: 10971 - DNA, 1712 bp, Homo sapiens
  ENST00000394052
atcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagtacagtctctttctttatattctcccaatagtcttctttttcccttgaaacttcatcagagactgtaagcattaacctggtttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccagggctaatttgagataagtacaattaagttaatctacatatatctaaaaggttttttttgtaataagtatctgatttccggaagatttactttactcaaggaactttaaaggttgtatcccccaccaaaaaaagaaaaaaaatcagaaggccaactgcgcaaacaa

SEQ ID NO: 10972 - DNA, 1116 bp, Homo sapiens
  ENST00000581564
tcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggttttgttttaccatcaggtgagtttctgacataaataaactcatttgaaaagtgatgtactatttacagggattactttataaggaaattaaatactttaaagtcgaaaaaaaacaagcaatatttgaataaaagtttgaatataatttgtgaacagtaattcaatactgtaatttaatatatcataaatgatattttcacagccattataaatgaaatatcttttactacaaaagtcccacaaaagtatgagaatgaaaatgtagaaacagtaaccaaacaggcaatcttaaatgggagtatcgttaaggagagcactgaagctcatggcactattcagtaagtaaagaaactttgactaagaaataataataaatatatgtaaagaaattaactttgcgtaatcccagtaattactcttctttgtttaaatgtttccaaacatagttttagtatactgtgatttttttttttttttttga

SEQ ID NO: 10973 - DNA, 490 bp, Homo sapiens
  ENST00000580719
ttccgcgcagaccgagcagactgccgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagaagcactccttgttttttgtttgttattgttgctgttggctttcttgttagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagat

SEQ ID NO: 10974 - DNA, 1881 bp, Homo sapiens
  ENST00000264651
actcttcgtcatcacctctcctattcgcctggacaagctcatgtttgcaggagcaccatgtcttgctcgtctcgcgcctcctcctccagggctggaggcagcagctcagccagggtgtctgctggtggaagcagcttcagcagtggaagcagatgtggtctggggggcagctcggcccagggcttccgaggaggagccagcagctgcagcctgagtggggggtctagcggtgcttttgggggcagctttggagggggctttggtagctgctcagtagggggtggttttgggggagcttcaggctctgggacaggatttggtgggggttctagctttggcggggtctctggatttggcaggggttctggattctgtgggagttctagattcagcagtggtgctactggaggcttctacagctatggtggtggtatgggaggtggtgttggcgatggggggcttttctctggaggggaaaagcaaaccatgcagaacctcaatgaccgcttggccaattacctagacaaggtcagagccctggaggaggctaacactgatctggagaacaaaatcaaggagtggtatgacaaatatgggcctgggtctggagacggtggatcgggaagagattatagcaaatactattcaataattgaagatctcagaaaccagatcattgctgccactgttgaaaatgctgggatcattttgcacattgacaatgccagattggctgctgatgacttcagactgaagtatgagaacgagctgtgtctccggcagagcgtggaggctgacatcaatggcctgcggaaagtcctggatgacctgactatgacccgctctgacctggagatgcagattgagagtttcaccgaggagctagcctacctgaggaagaaccacgaggaggaaatgaagaatatgcaaggaagctctggaggggaggtgaccgtagaaatgaatgctgcgccagggaccgacctgaccaaattactgaatgacatgagggcgcagtacgaggagctggctgagcaaaaccgccgagaggctgaggagcggttcaacaagcagagcgcatcactacaagcacaaatctccactgatgctggggcagccacttctgccaagaatgagataacagaactaaaacgtaccctgcaagccctggaaattgagcttcagtcccaactggccatgaaaagctccctggagggaaccctggctgacacagaagctggctacgtggctcagctgtcagaaattcaaacgcagatcagtgccctggaggaggagatctgccagatctggggtgagactaaatgccagaacgcagagtacaagcaattgctggacatcaagacacgcctggaggtggagatcgagacctaccgccgcctgctcgatggagagggaggtggttctagttttgcagaatttggtggtagaaactcaggatctgtaaacatgggatccagggatctggtatctggtgactcaagatctggaagctgttctggtcaaggacgagattcaagcaagactagagtgactaagactatcgtagaggagttggtggatggcaaggttgtctcgtctcaagtcagcagtatttctgaggtgaaagttaaataaggaacttccagatcaacaaaagtgtctttcaaagaaaaaaaaatcaagaaggacacaagcgaagaaatggcatcaatctaggcatctttctggataatttcaggaaaagcttcagtccagaaatggatgactagccaacttttctgcatcttcttatttcctcattagaatgctcttgaaatagctgaattaacaactttgctttaattgtttctatgcttcaataaatttacttttgcaagttaa

SEQ ID NO: 10975 - DNA, 739 bp, Homo sapiens
  ENST00000360770
tcactgccctctgcctcgaccttatccagccacacgccaccatgtgtcataccagctgctcctcgggctgccagccagcctgctgcgcgcccagcccctgccagccagcctgttgtgtgcccagctcctgccaggcatcctgctgtgtgcctgtgggctgccagtcctccgtgtgtgtgcccgtgagcttcaagccagccgtgtgcctgcccgtgagctgccagtcttctgtgtgtgtgcccatgagcttcaagtcagctgtgtgcgtgcccgtgagctgccagtcttctgtgtgtgtgcctgtgagctgcaggcccattgtgtgtgcagccccctcctgccagtcctccctgtgcgtgcctgtgagctgcaggcctgtcgtgtatgcggctccgtcctgccagtcctctgggtgctgccagccctcctgcaccagcgtcctctgcagacccatctcctacagtatctcttcctgctgctgagcatgaatctccagacccgctgctcccagtgcagatgaggccacacctgtacactccctggatgagtcctcagttggtcttctgcacatggtgcaggtgaaaagcatgctcagttgaaccctctgaattctggattgagaatgtgacagaatgatctggagcccttgctgaccttgcccatccccccagggaagtctggggtcccagagtcattctctgaccccatgagagccaaataaaccagctttccccatgca

SEQ ID NO: 10976 - DNA, 17726 bp, Homo sapiens
  ENST00000339824
aggcaagatgtcggtgtggagcgaggcaggagcgattgcagcaaccgtcacccccggagcccggcggcggcagcagcagcagcagcagcagcgcggggaggagacagcagccagccgcagtagccgccgcagccgcgggagcaatgcagacagcaccttgagaacgcgctaaagcactccaaaccgtggaccatgccgtgtccctgcaactgggaggggggaaaaccagattttttttgacataaaagcaagccagccaaaaatatataattttgtccttcaaggagccggtgtgtaaagagtgagcgctattttccttctcctcctcctcctctccctcctcctcctctccctcctcctctctctcctccttctcctcttctttttcctcctcctcctcctccctaagtgtacagacagcatcacatcacctggtttgcttctgagaaacagcatctctccttttcagggaccagagactcagagagagaggagacattctaatggagtccgcttgatatcccaaaataaaataataaattttggctcttgtcccctcctcccactcccaccccctcaaccctgtgtgagatgttggatttcttcttcatgagacattgttgagaagtcgcagtggttggagaggcggagggtagactacctctactcccccccctcttttttctctctgggaggaggaggaggggaagggggttgcagagcaagcgatggatgaggaaaacatgacgaaaagcgaggagcagcagcctctgagtttgcaaaaagccttacagcagtgcgaactggtccaaaacatgatagacttgagcatctccaacctggaagggcttaggaccaaatgtgctacctccaacgacctcacacaaaaagaaatccggaccctggagagcaagctggtgaagtacttcagccggcagctgtcctgcaaaaagaaggtagccttgcaggagcgcaacgcggagctggacggcttcccccagctacggcactggttccgaatcgtcgatgtgcgcaaggaggtcctggaggaaatctcccccggccagctgagcctggaggacctcttggagatgacggatgaacaggtgtgcgagactgtggagaaatacggagccaaccgggaggagtgtgcccgcctcaacgcctccctctcctgcctcaggaatgtccacatgtcaggaggcaacctttccaaacaagactggaccatccagtggcccacgacagagacggggaaggagaacaatcccgtgtgccccccggagcccaccccgtggatccgcacccatctctcccagagccccagggtcccgtccaagtgcgtccagcactattgtcacaccagccccactcccggggcccctgtgtacacccacgtggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaaagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagagctgtgacctttggacatcgggacggcgcccagctgcctgggctcccgtcacctctccctccctactctgtcctctgccagctcaggaggccagagactcagcatcagagggtaccaaccccgaccgacctgggagcactggacaactgctcggcggcctccctgcacctcagacttgagcccttttcctcgggcagggttggggacccccgagctaggactgaaccggaccagccagggtgatgcgttattgatcagtgcggcccaggggacagcactaatgagagcactgcaggctgcacgtggtgcctttgggctatgggactaggacaggagaccccacgtgggggggctcacagacggggctatgtgtgtgtgtgtctgtgtgtttgacgttgttcactcttgtttccccttgacaagcaagagccagactgtcccaatgacggggcactcctcagttctgtctgtatgtggtaggttccagctgtaccatctgggaagctaagaggagggtacagagccgagtggcagcttagtcaaggctactgagccaagatcgagcagggaaggtcgggagtggctaagctcgttcctttggaaatatctgttttcagacaccccaacccgagcctgtcatggcgtgtggcacctttgcatagagctctgaagtacagtaggaaagttagaacgtcttttgagttctgggtctctctgggggacctattcccccatttctgctgttttctcctgttctctgagagtagcatcccttttcacctcactgcccgcacctccttgccatttggaaagccaagatgacttctgaggggctccttagagctcaccgtcattcagggcaccccctgaagtctggtccctgagaatcagggctctgggcagggagttctaggacattccttttcttccctcttctctgctactcacaccagtgaagcttattcccccaccaaggtggatgcgggttcttggggtacgtccatgttgggttatgtggctgtacctatgataacacgtttgcaaaagatttccctgcctgtcacccttgaggagtcctgttgggggagcacaaagggaggatgtttgttacacttctgcgttctttgctctagcctggtgcggggtcctcaagtagcttccccatcggaagcctgtgtccctcacctgtgtgtgttccctcagtgccccaccttccctccctcctcttgatcccaacctgggccggcgactcttcctgaccatgttggggaagcccctggtgttctgtatctgtaggaaggatgccgagagcaggctgggcatgcagatgggagaggagaacctctgggtcatttgcccatgttttcaaagccctgaccccctgcatgtgacctgatacaaaagggaaatctgtccccaagcagagcaatagcaggattatctgggcagtgaacaggaagcccagggcggccacagcccctctgtgtttcctgggtactacctgggccttagttttcttgtagctactatctatccaggcatctccctcctagagggccagagagaggaactggaacttcaaaaaccctacctgatcttactttcaaaatccaaatagacctatgaggatctcttccccaccttgggtgactcccagactggttcatgctctgggggccaaacctgcttccaaaccgggaagaatggtgagatcagtcatgcttcccaggagcctggctacaggaaacccctgtgtttcccaaagggccctcctgaattgcctttccaacactcccagcttactgggactagaggactaaagaccccggcttgggctgctcctaagcagacactgctcttctggggacatctatggctcttggcttgacgacgtgtgtgtgtcttggaggcattttatatatgtttgcctgagccccagccactctggggttgctggggatggctcttgtcaatggacacctccccatcccaacacaacactctgtgtcccagccctgggcctggacttgcacctgtcttggctctgcccagcagcctactgagtgcctgaaacccaaccactcacttctcttccatcacaccaggacttcttgggtccacaggctccagtccttgtcatgttcccttgtgccaagagacaggatatgaggaagggaagaggcagccagggtctactaccctgcagctgaaatgtccacaagaactggcaccttctcactcttgcctctcttgtttccagaattaactaaaatgtccaaccacagcctttggcaaggcctagcatgatctccaacagctgatttttccattcattcatgagcaccagtttgggattaaggacagggcctgagtgatccaggggaaaacccagccctttgtggaacagggtgccttgggtccatccctgaatctgagtcacttgctcttgacttctcgatctttccccacttcactactctgtccccacctgcattggtctctgctgcagccaggccaggatcctggccttcagtgccttcctgacgcccctaccctgtcccctctacaccgccctgacttgttgagaaaccagctttaatttgcacacatttaaatccaggaagaaccaaaccgctgctttccctgctggcttccatctttattcgctgatgaggttttgggaggaggttatattcatcttacgcagggaggaaaaaaaaagaggaaagaggctgtatatttttacatcataattaccagcctcacctgcaactcattctatacaatgacacgaccaagatttgtgtgtttgcccttgtcccatcacagctgcacacaggtgccctgtacacataagtcactgactcagcagcgagttgttccagtcagtcttgcttttagcaaaccgtcatatacatgggcttcccgaggggaccagtccacagggtgaagattcaccaggaagccttggctttgcagagagaaacatctcagctttctttaaagggcatgtggatttgcacataaatttcacccaactcttccaggatacagattattcataaaaccaaggagcttccttcttggccccctgtgggaggacgtgccccttgtgtccccatccccagagccaagctggaaacccaaagtcattgcttagatccattttgtcctggtattccttttactgatcaaagagaaaattttcatcttgccatggacccccccatcctcaccccatccacttgtctccacagctaccttggattgtcagtcaatagaagcccttgactgatattgaccactagacttttgtatccagggaacctagttcttccctttttctcacctcccatgccatatacacacatcatgcccctccccacaaacacacgaaaccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgaggaaaaatcaaaagaataatatttcatgacatgaaaattctataacattcaaatttcatgtcaataaacaaaatgttattggagcacagtcacctctccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctaggactgctgcagcaaaccaccacccactggggcctacaacaacagatgtatcatctctcacccatctggatgccagaagtccaaaatcaaagtgttagcagggccatgttccccctgaaatctgtaagggaatccttcctggcggcttctgaattcctggtgctttcctggtcatcattggcattccttggcttgcagctgtgtcagtccaatccctgccctcatcatctctctgtgtgtccctatcttcatatggccatcttcttataaggacacgagtcacattggattaagggcccaccctatttcagtatgacctcatcttaactaattatatctgcaaagaccctctctccaaatgaagtctcattctgaggtactaggaatgaggacttcaacatgtctttttttttttttttttttttttgttggggacaccacaacttataacaccctctaagacattttctcttgtgccttgactggtcctccactgtagaacccaggtgcccttgaagatagattccccagaattcctggtctacaaggtcaggctgttgctgtcatgcttaccaagcttgccccaatcaacacgtcccatcactgaattccaacagctctggatctcagttctgtggctgtatgggaacagcctgtgtgtaagtggcttgtctgtagcggactgtcacttgacccctgaatgtgcctcatgaccctatccaaagcagttggtgacacagcatctgattttatctatactcttgttcattgacaaaggagtggattttgatgagctacattttgctgtttccttttttggctttgcctgtgatgtggggaagttcctaggcagactcatgtggccactctccctggctcccagcctcacctcctcccgtaccacctcaccctcacctgcacacacctgcaagggaatcactttgaactccaaggggagtgacaggcagcaaatgtcagtctgggtcctggaatgtggagccgcagtgaacctctgtcctctctggtcagtgcctgactatgatattaacccaaatcccagactcccttctcgaggccctgcaatccatacccattctgttaccagtttagttttgaaaccagtagtggggcaggaggttgatggaaaatctgcggtcccagtgacctcctggacttgtcttagtagtgcctggcacatagtaagtgctcaagaaatgtttacagaatgcagacagagaggtttgctgggtaagagtaagaccctggcacagggagttagaagggcaccattggcagggctggatggtattgggattcccctttgccagaccatgttgtgggtgccatatcaaccccaatgagtttgtttgttaggtttgttgttgtggtttagagttagagtcttgctctgtcacccaggctggagtacagcgtgatcatagctcactgcagcctcgaactcctggccacaagcaatcctcccaccttagcctctcaagttgctggtactacaggtgcacaccatcatgcctggctaattttttatttgttgtacagacagggtcttgctatgttgcccgcgctggtcttgaactcctggtctcaagcaatccccctgcttcagcctcccaaagcactgggattacagggctaagccattgtgctgagccagtttgccaggtttaatatctgtgacgtatgaagcgacccattgagtcaggtggcccaggatgtctaggaggcagagtaacaatccaccctgaacagccctcattcacagagcacttactacgtgccaggctggaattcctatgatggtttggggagatcagtagtcttattctcgttccaatggggcaactgtggtacagggacagaaaccagcctccaaattgcagacccagcattttaaaaacgagtctttgggctcatccattcccaggaacccacctccaggtcaaggggttcatgtccagctgctcatggggatgttacaatcccagcctctgagacttattggcaacttggaaccaggaaagagagagaggaaaagcaggaagttgtggaagggagggtgcaggggctggcagggaccatactgggagtttgcacggaagcttgaacttatgttctcaaactgacaggctgccagcagcagcccggatttccaggaaatgtacatctgggttggcagagtccctcctgggtccctccagtatccctgctccaggcttcctatcccctccgtctctcctgctggatgttgcactgtggtcccgtgttcctgagaggcgtacatcagtgagtgctcttccctctcaggggtgggaaagggcccttccttcccactcattgggatcatgcagctcccatttcctaacaccaagaatatgaaggattcatctcatggggttgagaatggctgtcctccttccactgaggactgagctggaggagatggactctgtctagaatgtgcctgatctaaataagaccttgtttcccaagcatgtcccatagacctttcattccatggaaaactcgccggatttgcattattgaaagggtcctgggacaagcatgcattggaaatgcttaggtaaaatgaaactaatttcttgattgcaggacttatcagaacttttaagacactattgtgtggttgaatctctaaatgcctgataggaggctgttcttcccaagctttcccaggcttgtttctgaatctccaacaaggtcaacctctgtgaatgagacttgataccttacctggtactgaaggaggcaatgtcaatgtactggcccacagaaaagagctgaccactagcattcatagacactgctaggagatgagaaaggtagcttagagcccgattccatccatgtggacagtggttccatgaacaagaacaccacatctggctgatggtgtcttccaatggaggggtcaaatctgctgtgtgttggtggcttctccaacataccatggcttggaggccaatgtgaaaagtatataagatgtaacaccctcagaagggttaagttttcacctgagttttcatcttcaaccaagtcattgggatggtgatctagaaggacctctaagatctagaaggataaagatctggtccaaggagtacaaatatgtaatggatctaccaccagtgtcccctgctgtactcttggcagacatcactaatccatcacagcatgccttcccactgatcacagatgtagcttcagggcattcgagttaccacttaagatggatatgagtgaccctcccttatctcactcttctcctttcacagaagcaggatctgaggcccagagagggaagctataataaactcccctaagtcaggtcccttctaagaggcagaggtaggtttagaactcaggcctcagaaacttccagaagccaagccatttgggctgtagttggtggacagtctatcagcgctctgcagatgtttcttctcagttagggaacttggaaaatgcagaaagaaagattctgtctctaagactctgtgtatgatcctactcggtaatctgcctgcttggagaaaaatcatttatcttctgggacggcttcaccacaaggcctgaatgctatgcccagtctagtaacagctgggctggaagtcacggcatatgggggccttaaggaataacagtgtgcgtggtggtgtgcaggagagctgcaagggcttttctttcttgaggaggtttgtaaaatttctgctgttcagtctgggcttctgggaagtcagggggtgctgcatataaagggcaggaaaaggagcctgactccaattgctctttggtttcttccctgaatggaaggctcaaaatcaagtttccacccagataagatcttgaggtcctagtggaccaccagctctactcctgagctcttgaaatacctctaatcaccagctcggtggctgagagtaccttcttgtccactgcctcttcttttccttctcgtcttcacttatcccccatccaacttctgcccgataatatctcccctgtattgtaaactgaggagaaagttgcacaattgtagagatgaaaaatagctgccatgtatttagcttaaattagctcagaagaaaggctccctccctccattgagcgggcagcacttgtttatgccaacatgctatttgcatcgcgccttcttaaatttgaaagtctaatgattaaaaacaaatcttagtttttcttttccaccacttaaaaaaaaaaaaccagcttggctagttcttctagtttaaaaataccctgacctccagcactacagtgagaattttggaaaggctggtaccaggatatcaggaggaaataaatacaggccaacaataaccagaggccttttctgagtggtgggcgacaggatgaacaaggtagaagagaggtctttgtgtcctcacacagatgctggcattctgggtttgtctggaattcagtgaacctctgtcctctctgacagagatttcttcaccaaccattcattcagtgggtgatttgttgagcatctactatgtgttagaccctgggcattcagtgatgagtgatacaatgtctcacctgttctgaagcctaaagcccaatggggaagagagacaagaagcaagtcaaccacaaatatataaatttgcaactcatgtagatctatggaaagaaaactcacgggggaccagaaacatgggagagggtatactgtgggagagctgctgacaaaggtctttctgaggaggtgacatttaagtcaagatctaaaggaagagaaggataaagagatgttcattctaagccagggtttctcaacctcagtactgttgagctatttggggccagataattctttgaggtggcgactgtcctgggcattggaggatgttaagcagcttcctcaactctccccacaagataccagtagcacctggtactggtgacatccaaaaacatccccagacacaccctgactttgctgtctggaatcaatcctcataaagccccaagccttggagcacagaggctggaagcccatatggtggcatgtcaggcatggtgtcacctgagcttctctgacccccacttctgatatggcatccagtttggagtctctgttctccatgagctcccatagctgtcccatattccacaaggcattgcttctgggccacggtcctctagttccagcatagccctatttttgggtatgttggtggatttcaaaagcctccagttgacatccaaagtgtgacatccaaaaccatctccagacattgccagatgtcccctgagttgtctccaggccacgcgactaggattcaaatccagcatcctgccatctgcaaccttccatgggagaaaggaaatcagaggagaacaggaaaacacaaggaggggactccttaagtgaacattgcagggaaataggtttttaaagcactagttagcatcaccagtggtttgaaggctgtctaggtaaggagaatgtggacttgcctttcaccgtctgcacggacaggggctgaaatctccagtcattctctccatccttccacagcccttctaagaagcagatcctcttgctgagctgaaatcttgagacttgcatccggcaatcttggtgttgctttctgaggctactcagggaaagcccttctgtattccccaggaaggaaagtctcccagatagtgaagggccttttctaccttccttgcaattcccagttcactgtgaagaagagagtcaggccgggttagaatggctgtctctggtagcaatgaagcaacaacatagacagtctggacaagatgtggcagttctgtccagtcccgtgtgactgatttgggcatggagacaggcagtgggtgaggatggcctctgtaggtccagctgttttacccctagaatcaaatccctggagcttccggcagtcccaggattgggaagggtaacagagaggacgagtcgggcactgcaaaagaccagatcttggaaaattgctttgggaattgggacaccttccaagaagacagttgagttggctggggctctgccctagatggggtcaacctctccccaacacagccctgcccaggttggggcattggcagcttaagtgcgtcctggacaacaaatgtaatgtattggtcctgtaagattctagccattttcctctgcttatttttctacatgtgttacaagtaataatgtttagatgggtacatatgaacttgtgtaagttcaagtaactgctatgtagctacagcatgggcatcaaggtactctaaggtacttgccctgccacaccgaggccccctgccccggccccctttccctcctagccagccttctagggagcactgcacaccctgccccttcaaagctatctggacagtcctggctcgactggagcattaagggaggggctgtccttggtcaggcttctgcccaactgtgtgatgcataaatctttgcctggctccttcttccttcttttcggaagtctatctcctcctgagggcctctgcggtcctaacctatcaaggaatatcatagattgtactccccaccccatcaaaacacaccctgactttgcgtctggaatcaatcctcataaagccccaaggcttggagcacagaggccagaagcccatatggtggcatgtcaggcatgctgtcacatgagcttctctgactccacttccaagatggcatccaatttggagtctctgttctccatgagctcccatagctgtcccatattccacaaggcactgcttctgggccccggtcctctagtttcctcatagccctatttttgggtacattggtggatttcaaatgcctacagttgagcagccgaaggattctaagaaaattttgcttgtatttcaaaggctcatgtccccagccccattcactacaccctcagcagagcccagcgtggagcaaccttgtcccttcattccccaaatcttcattttatatagtcatttagtaaatatttgttaagtgcctcctgtgattctggaaaaaatggagaaaagtgggtgctgccttcagggtactaggagtccgatgaagagagggaggagttccagtagggtcccgaggccccacaggagctcccaacccagagaaagaccctccaggaaggattctcagaggaggagacttctgaaccctgtcttgaaatttgagtagaatggtagggaacggtgtgtcagacagaaggaacagcctatgtgtggactcagaggcaagatcatgatttattgagggtaactgcaagtggctaaaatcctgccccctggcacttgcctgcctttccctgctttccccaaagcctgattttgggaccctggagtctccatctccaaacagagggtgccctggctcagatgtggagaccttgacttctttccccagcatgctctggttcctactgttagccttggtgtcctgtgggggaagatgtctgaggagagttttgtgcttgctggagtcagaccagtactcaggccacctcaggcctgctctgcatccctctctggctctacagacctctctctctctctctctctctctctctctctctctctgtctgtctgtctctgtgtctgtctctgtctctgcctgcctccacacagtgaaggatgtgtctctatttcttagtgccctgcattgggtcctgaagtccatgggcatcttggctatagatgggttggccatgagcccttctctctaatgcatttttcattcctgttcctcttttgcttcactttccctctatcgactcttgcgacctgtgtctctgatgtctctggggcccccagttctgtcttgccataccaaaaaaccttcttcagcaaaaaacctctttctgggacagttcatatcactctatgaataggcccctgaagtgttgaggtcaaggacatgtgtgaacgtggaaatgtatttatggaaagaccctacactgagggtctctaactaaacatttcaggtatgatgggcaaaatgctggtttgttacagaaatgactgaagaagacctaggggccatagtgggccacaggccaagcctgcaatacagcctgaagtgtgggaaagaatgtatcagtcctgttgatggagtggtgtgtttgctgtctctataaatatgtcagggtttgaaagacagaaaacaaagcatctttgctgaccgccagactcccagggtatatgtggctactgcaaattagcgaggcttgtttatctgcttcaacttgactcaatttgcatttcttgagccactgtctattgtggataatgatttcatcaacactttctcagcatcagcagcccctccagagtattccttgaattttcttagctttgtgcaacccacgagcacttaatatatcactaacccttgagtttattggagggagtgaatgaaataatgaatgtcaataacgttacgcaatacctggcacacagtaggtgcttcatcaatgtggcttttcttctcaatcacccaaatgaacctcccccagaatcccacctctagggggacattcctgaaaaataagggactagaatagcgaggtggtgggtgttacccatttatttagatatttgtgtcctggtgaacatggggagggatgcccaagtgtcataaggacaccccctccccccgtctacaaggcagaggtctcttaggatgtgagagagtctctggcaagaccagcccccaccccaccaaggccctcatagaaacagaacattcttcctccctatcccaaagcagaagttgactggggcagataaggcaagtcacattacatctgtgcccttgaccatacctggaccaggcagagaagatcccagacttaggtggtcaacgtttccaccccaagcctctcatttctcgctctctttgagacttgatcttgtaccaggatccactcgacagacttaacgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccagcaagcctgttgtttcttgtgtttagtgcaatgtttagtgagaaaccaatgtctgaattatttatgccaataaaaaatttgagaatta

SEQ ID NO: 10977 - DNA, 1512 bp, Homo sapiens
  ENST00000545002
aggacttcaacataggaacttgagggggacaaaattcagcccataacatgcattgatgtataacaaaaaagcaaaaatggaaccaaatgcaagtgagtctgcgattccagcgaggaggcagcggcagcccagagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccaggccagtttgattgtcctaaatataacgtacaggagttggggggcctgagcacatgaagattccgtccccatcatcgagtggaagcggcttccttttatgttcaaaaagctgaatcgctttccctttataaagcacagctgaaaaggt

SEQ ID NO: 10978 - DNA, 477 bp, Homo sapiens
  ENST00000543793
acctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccaggtacctccatgcttggggagacatgaggggtgcagcgttggaggggcagagattagggagggggtgggttcatgccagagccctgatgcagcaagtctctgcaggaaagcgaatgggtcaatgaccagagaggggcaaggaagtatgtggactgacccttatcgtaccctaagcaattacccttatatcacttatttaatctttggaacagccacaaggtaagcattatcagctcattttacagatg

SEQ ID NO: 10979 - DNA, 17008 bp, Homo sapiens
  ENST00000425217
gcagcagcctctgagtttgcaaaaagccttacagcagtgcgaactggtccaaaacatgatagacttgagcatctccaacctggaagggcttaggaccaaatgtgctacctccaacgacctcacacaaaaagaaatccggaccctggagagcaagctggtgaagtacttcagccggcagctgtcctgcaaaaagaaggtagccttgcaggagcgcaacgcggagctggacggcttcccccagctacggcactggttccgaatcgtcgatgtgcgcaaggaggtcctggaggaaatctcccccggccagctgagcctggaggacctcttggagatgacggatgaacaggtgtgcgagactgtggagaaatacggagccaaccgggaggagtgtgcccgcctcaacgcctccctctcctgcctcaggaatgtccacatgtcaggaggcaacctttccaaacaagactggaccatccagtggcccacgacagagacggggaaggagaacaatcccgtgtgccccccggagcccaccccgtggatccgcacccatctctcccagagccccagggtcccgtccaagtgcgtccagcactattgtcacaccagccccactcccggggcccctgtgtacacccacgtggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaaagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagagctgtgacctttggacatcgggacggcgcccagctgcctgggctcccgtcacctctccctccctactctgtcctctgccagctcaggaggccagagactcagcatcagagggtaccaaccccgaccgacctgggagcactggacaactgctcggcggcctccctgcacctcagacttgagcccttttcctcgggcagggttggggacccccgagctaggactgaaccggaccagccagggtgatgcgttattgatcagtgcggcccaggggacagcactaatgagagcactgcaggctgcacgtggtgcctttgggctatgggactaggacaggagaccccacgtgggggggctcacagacggggctatgtgtgtgtgtgtctgtgtgtttgacgttgttcactcttgtttccccttgacaagcaagagccagactgtcccaatgacggggcactcctcagttctgtctgtatgtggtaggttccagctgtaccatctgggaagctaagaggagggtacagagccgagtggcagcttagtcaaggctactgagccaagatcgagcagggaaggtcgggagtggctaagctcgttcctttggaaatatctgttttcagacaccccaacccgagcctgtcatggcgtgtggcacctttgcatagagctctgaagtacagtaggaaagttagaacgtcttttgagttctgggtctctctgggggacctattcccccatttctgctgttttctcctgttctctgagagtagcatcccttttcacctcactgcccgcacctccttgccatttggaaagccaagatgacttctgaggggctccttagagctcaccgtcattcagggcaccccctgaagtctggtccctgagaatcagggctctgggcagggagttctaggacattccttttcttccctcttctctgctactcacaccagtgaagcttattcccccaccaaggtggatgcgggttcttggggtacgtccatgttgggttatgtggctgtacctatgataacacgtttgcaaaagatttccctgcctgtcacccttgaggagtcctgttgggggagcacaaagggaggatgtttgttacacttctgcgttctttgctctagcctggtgcggggtcctcaagtagcttccccatcggaagcctgtgtccctcacctgtgtgtgttccctcagtgccccaccttccctccctcctcttgatcccaacctgggccggcgactcttcctgaccatgttggggaagcccctggtgttctgtatctgtaggaaggatgccgagagcaggctgggcatgcagatgggagaggagaacctctgggtcatttgcccatgttttcaaagccctgaccccctgcatgtgacctgatacaaaagggaaatctgtccccaagcagagcaatagcaggattatctgggcagtgaacaggaagcccagggcggccacagcccctctgtgtttcctgggtactacctgggccttagttttcttgtagctactatctatccaggcatctccctcctagagggccagagagaggaactggaacttcaaaaaccctacctgatcttactttcaaaatccaaatagacctatgaggatctcttccccaccttgggtgactcccagactggttcatgctctgggggccaaacctgcttccaaaccgggaagaatggtgagatcagtcatgcttcccaggagcctggctacaggaaacccctgtgtttcccaaagggccctcctgaattgcctttccaacactcccagcttactgggactagaggactaaagaccccggcttgggctgctcctaagcagacactgctcttctggggacatctatggctcttggcttgacgacgtgtgtgtgtcttggaggcattttatatatgtttgcctgagccccagccactctggggttgctggggatggctcttgtcaatggacacctccccatcccaacacaacactctgtgtcccagccctgggcctggacttgcacctgtcttggctctgcccagcagcctactgagtgcctgaaacccaaccactcacttctcttccatcacaccaggacttcttgggtccacaggctccagtccttgtcatgttcccttgtgccaagagacaggatatgaggaagggaagaggcagccagggtctactaccctgcagctgaaatgtccacaagaactggcaccttctcactcttgcctctcttgtttccagaattaactaaaatgtccaaccacagcctttggcaaggcctagcatgatctccaacagctgatttttccattcattcatgagcaccagtttgggattaaggacagggcctgagtgatccaggggaaaacccagccctttgtggaacagggtgccttgggtccatccctgaatctgagtcacttgctcttgacttctcgatctttccccacttcactactctgtccccacctgcattggtctctgctgcagccaggccaggatcctggccttcagtgccttcctgacgcccctaccctgtcccctctacaccgccctgacttgttgagaaaccagctttaatttgcacacatttaaatccaggaagaaccaaaccgctgctttccctgctggcttccatctttattcgctgatgaggttttgggaggaggttatattcatcttacgcagggaggaaaaaaaaagaggaaagaggctgtatatttttacatcataattaccagcctcacctgcaactcattctatacaatgacacgaccaagatttgtgtgtttgcccttgtcccatcacagctgcacacaggtgccctgtacacataagtcactgactcagcagcgagttgttccagtcagtcttgcttttagcaaaccgtcatatacatgggcttcccgaggggaccagtccacagggtgaagattcaccaggaagccttggctttgcagagagaaacatctcagctttctttaaagggcatgtggatttgcacataaatttcacccaactcttccaggatacagattattcataaaaccaaggagcttccttcttggccccctgtgggaggacgtgccccttgtgtccccatccccagagccaagctggaaacccaaagtcattgcttagatccattttgtcctggtattccttttactgatcaaagagaaaattttcatcttgccatggacccccccatcctcaccccatccacttgtctccacagctaccttggattgtcagtcaatagaagcccttgactgatattgaccactagacttttgtatccagggaacctagttcttccctttttctcacctcccatgccatatacacacatcatgcccctccccacaaacacacgaaaccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgaggaaaaatcaaaagaataatatttcatgacatgaaaattctataacattcaaatttcatgtcaataaacaaaatgttattggagcacagtcacctctccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctaggactgctgcagcaaaccaccacccactggggcctacaacaacagatgtatcatctctcacccatctggatgccagaagtccaaaatcaaagtgttagcagggccatgttccccctgaaatctgtaagggaatccttcctggcggcttctgaattcctggtgctttcctggtcatcattggcattccttggcttgcagctgtgtcagtccaatccctgccctcatcatctctctgtgtgtccctatcttcatatggccatcttcttataaggacacgagtcacattggattaagggcccaccctatttcagtatgacctcatcttaactaattatatctgcaaagaccctctctccaaatgaagtctcattctgaggtactaggaatgaggacttcaacatgtctttttttttttttttttttttttgttggggacaccacaacttataacaccctctaagacattttctcttgtgccttgactggtcctccactgtagaacccaggtgcccttgaagatagattccccagaattcctggtctacaaggtcaggctgttgctgtcatgcttaccaagcttgccccaatcaacacgtcccatcactgaattccaacagctctggatctcagttctgtggctgtatgggaacagcctgtgtgtaagtggcttgtctgtagcggactgtcacttgacccctgaatgtgcctcatgaccctatccaaagcagttggtgacacagcatctgattttatctatactcttgttcattgacaaaggagtggattttgatgagctacattttgctgtttccttttttggctttgcctgtgatgtggggaagttcctaggcagactcatgtggccactctccctggctcccagcctcacctcctcccgtaccacctcaccctcacctgcacacacctgcaagggaatcactttgaactccaaggggagtgacaggcagcaaatgtcagtctgggtcctggaatgtggagccgcagtgaacctctgtcctctctggtcagtgcctgactatgatattaacccaaatcccagactcccttctcgaggccctgcaatccatacccattctgttaccagtttagttttgaaaccagtagtggggcaggaggttgatggaaaatctgcggtcccagtgacctcctggacttgtcttagtagtgcctggcacatagtaagtgctcaagaaatgtttacagaatgcagacagagaggtttgctgggtaagagtaagaccctggcacagggagttagaagggcaccattggcagggctggatggtattgggattcccctttgccagaccatgttgtgggtgccatatcaaccccaatgagtttgtttgttaggtttgttgttgtggtttagagttagagtcttgctctgtcacccaggctggagtacagcgtgatcatagctcactgcagcctcgaactcctggccacaagcaatcctcccaccttagcctctcaagttgctggtactacaggtgcacaccatcatgcctggctaattttttatttgttgtacagacagggtcttgctatgttgcccgcgctggtcttgaactcctggtctcaagcaatccccctgcttcagcctcccaaagcactgggattacagggctaagccattgtgctgagccagtttgccaggtttaatatctgtgacgtatgaagcgacccattgagtcaggtggcccaggatgtctaggaggcagagtaacaatccaccctgaacagccctcattcacagagcacttactacgtgccaggctggaattcctatgatggtttggggagatcagtagtcttattctcgttccaatggggcaactgtggtacagggacagaaaccagcctccaaattgcagacccagcattttaaaaacgagtctttgggctcatccattcccaggaacccacctccaggtcaaggggttcatgtccagctgctcatggggatgttacaatcccagcctctgagacttattggcaacttggaaccaggaaagagagagaggaaaagcaggaagttgtggaagggagggtgcaggggctggcagggaccatactgggagtttgcacggaagcttgaacttatgttctcaaactgacaggctgccagcagcagcccggatttccaggaaatgtacatctgggttggcagagtccctcctgggtccctccagtatccctgctccaggcttcctatcccctccgtctctcctgctggatgttgcactgtggtcccgtgttcctgagaggcgtacatcagtgagtgctcttccctctcaggggtgggaaagggcccttccttcccactcattgggatcatgcagctcccatttcctaacaccaagaatatgaaggattcatctcatggggttgagaatggctgtcctccttccactgaggactgagctggaggagatggactctgtctagaatgtgcctgatctaaataagaccttgtttcccaagcatgtcccatagacctttcattccatggaaaactcgccggatttgcattattgaaagggtcctgggacaagcatgcattggaaatgcttaggtaaaatgaaactaatttcttgattgcaggacttatcagaacttttaagacactattgtgtggttgaatctctaaatgcctgataggaggctgttcttcccaagctttcccaggcttgtttctgaatctccaacaaggtcaacctctgtgaatgagacttgataccttacctggtactgaaggaggcaatgtcaatgtactggcccacagaaaagagctgaccactagcattcatagacactgctaggagatgagaaaggtagcttagagcccgattccatccatgtggacagtggttccatgaacaagaacaccacatctggctgatggtgtcttccaatggaggggtcaaatctgctgtgtgttggtggcttctccaacataccatggcttggaggccaatgtgaaaagtatataagatgtaacaccctcagaagggttaagttttcacctgagttttcatcttcaaccaagtcattgggatggtgatctagaaggacctctaagatctagaaggataaagatctggtccaaggagtacaaatatgtaatggatctaccaccagtgtcccctgctgtactcttggcagacatcactaatccatcacagcatgccttcccactgatcacagatgtagcttcagggcattcgagttaccacttaagatggatatgagtgaccctcccttatctcactcttctcctttcacagaagcaggatctgaggcccagagagggaagctataataaactcccctaagtcaggtcccttctaagaggcagaggtaggtttagaactcaggcctcagaaacttccagaagccaagccatttgggctgtagttggtggacagtctatcagcgctctgcagatgtttcttctcagttagggaacttggaaaatgcagaaagaaagattctgtctctaagactctgtgtatgatcctactcggtaatctgcctgcttggagaaaaatcatttatcttctgggacggcttcaccacaaggcctgaatgctatgcccagtctagtaacagctgggctggaagtcacggcatatgggggccttaaggaataacagtgtgcgtggtggtgtgcaggagagctgcaagggcttttctttcttgaggaggtttgtaaaatttctgctgttcagtctgggcttctgggaagtcagggggtgctgcatataaagggcaggaaaaggagcctgactccaattgctctttggtttcttccctgaatggaaggctcaaaatcaagtttccacccagataagatcttgaggtcctagtggaccaccagctctactcctgagctcttgaaatacctctaatcaccagctcggtggctgagagtaccttcttgtccactgcctcttcttttccttctcgtcttcacttatcccccatccaacttctgcccgataatatctcccctgtattgtaaactgaggagaaagttgcacaattgtagagatgaaaaatagctgccatgtatttagcttaaattagctcagaagaaaggctccctccctccattgagcgggcagcacttgtttatgccaacatgctatttgcatcgcgccttcttaaatttgaaagtctaatgattaaaaacaaatcttagtttttcttttccaccacttaaaaaaaaaaaaccagcttggctagttcttctagtttaaaaataccctgacctccagcactacagtgagaattttggaaaggctggtaccaggatatcaggaggaaataaatacaggccaacaataaccagaggccttttctgagtggtgggcgacaggatgaacaaggtagaagagaggtctttgtgtcctcacacagatgctggcattctgggtttgtctggaattcagtgaacctctgtcctctctgacagagatttcttcaccaaccattcattcagtgggtgatttgttgagcatctactatgtgttagaccctgggcattcagtgatgagtgatacaatgtctcacctgttctgaagcctaaagcccaatggggaagagagacaagaagcaagtcaaccacaaatatataaatttgcaactcatgtagatctatggaaagaaaactcacgggggaccagaaacatgggagagggtatactgtgggagagctgctgacaaaggtctttctgaggaggtgacatttaagtcaagatctaaaggaagagaaggataaagagatgttcattctaagccagggtttctcaacctcagtactgttgagctatttggggccagataattctttgaggtggcgactgtcctgggcattggaggatgttaagcagcttcctcaactctccccacaagataccagtagcacctggtactggtgacatccaaaaacatccccagacacaccctgactttgctgtctggaatcaatcctcataaagccccaagccttggagcacagaggctggaagcccatatggtggcatgtcaggcatggtgtcacctgagcttctctgacccccacttctgatatggcatccagtttggagtctctgttctccatgagctcccatagctgtcccatattccacaaggcattgcttctgggccacggtcctctagttccagcatagccctatttttgggtatgttggtggatttcaaaagcctccagttgacatccaaagtgtgacatccaaaaccatctccagacattgccagatgtcccctgagttgtctccaggccacgcgactaggattcaaatccagcatcctgccatctgcaaccttccatgggagaaaggaaatcagaggagaacaggaaaacacaaggaggggactccttaagtgaacattgcagggaaataggtttttaaagcactagttagcatcaccagtggtttgaaggctgtctaggtaaggagaatgtggacttgcctttcaccgtctgcacggacaggggctgaaatctccagtcattctctccatccttccacagcccttctaagaagcagatcctcttgctgagctgaaatcttgagacttgcatccggcaatcttggtgttgctttctgaggctactcagggaaagcccttctgtattccccaggaaggaaagtctcccagatagtgaagggccttttctaccttccttgcaattcccagttcactgtgaagaagagagtcaggccgggttagaatggctgtctctggtagcaatgaagcaacaacatagacagtctggacaagatgtggcagttctgtccagtcccgtgtgactgatttgggcatggagacaggcagtgggtgaggatggcctctgtaggtccagctgttttacccctagaatcaaatccctggagcttccggcagtcccaggattgggaagggtaacagagaggacgagtcgggcactgcaaaagaccagatcttggaaaattgctttgggaattgggacaccttccaagaagacagttgagttggctggggctctgccctagatggggtcaacctctccccaacacagccctgcccaggttggggcattggcagcttaagtgcgtcctggacaacaaatgtaatgtattggtcctgtaagattctagccattttcctctgcttatttttctacatgtgttacaagtaataatgtttagatgggtacatatgaacttgtgtaagttcaagtaactgctatgtagctacagcatgggcatcaaggtactctaaggtacttgccctgccacaccgaggccccctgccccggccccctttccctcctagccagccttctagggagcactgcacaccctgccccttcaaagctatctggacagtcctggctcgactggagcattaagggaggggctgtccttggtcaggcttctgcccaactgtgtgatgcataaatctttgcctggctccttcttccttcttttcggaagtctatctcctcctgagggcctctgcggtcctaacctatcaaggaatatcatagattgtactccccaccccatcaaaacacaccctgactttgcgtctggaatcaatcctcataaagccccaaggcttggagcacagaggccagaagcccatatggtggcatgtcaggcatgctgtcacatgagcttctctgactccacttccaagatggcatccaatttggagtctctgttctccatgagctcccatagctgtcccatattccacaaggcactgcttctgggccccggtcctctagtttcctcatagccctatttttgggtacattggtggatttcaaatgcctacagttgagcagccgaaggattctaagaaaattttgcttgtatttcaaaggctcatgtccccagccccattcactacaccctcagcagagcccagcgtggagcaaccttgtcccttcattccccaaatcttcattttatatagtcatttagtaaatatttgttaagtgcctcctgtgattctggaaaaaatggagaaaagtgggtgctgccttcagggtactaggagtccgatgaagagagggaggagttccagtagggtcccgaggccccacaggagctcccaacccagagaaagaccctccaggaaggattctcagaggaggagacttctgaaccctgtcttgaaatttgagtagaatggtagggaacggtgtgtcagacagaaggaacagcctatgtgtggactcagaggcaagatcatgatttattgagggtaactgcaagtggctaaaatcctgccccctggcacttgcctgcctttccctgctttccccaaagcctgattttgggaccctggagtctccatctccaaacagagggtgccctggctcagatgtggagaccttgacttctttccccagcatgctctggttcctactgttagccttggtgtcctgtgggggaagatgtctgaggagagttttgtgcttgctggagtcagaccagtactcaggccacctcaggcctgctctgcatccctctctggctctacagacctctctctctctctctctctctctctctctctctctctgtctgtctgtctctgtgtctgtctctgtctctgcctgcctccacacagtgaaggatgtgtctctatttcttagtgccctgcattgggtcctgaagtccatgggcatcttggctatagatgggttggccatgagcccttctctctaatgcatttttcattcctgttcctcttttgcttcactttccctctatcgactcttgcgacctgtgtctctgatgtctctggggcccccagttctgtcttgccataccaaaaaaccttcttcagcaaaaaacctctttctgggacagttcatatcactctatgaataggcccctgaagtgttgaggtcaaggacatgtgtgaacgtggaaatgtatttatggaaagaccctacactgagggtctctaactaaacatttcaggtatgatgggcaaaatgctggtttgttacagaaatgactgaagaagacctaggggccatagtgggccacaggccaagcctgcaatacagcctgaagtgtgggaaagaatgtatcagtcctgttgatggagtggtgtgtttgctgtctctataaatatgtcagggtttgaaagacagaaaacaaagcatctttgctgaccgccagactcccagggtatatgtggctactgcaaattagcgaggcttgtttatctgcttcaacttgactcaatttgcatttcttgagccactgtctattgtggataatgatttcatcaacactttctcagcatcagcagcccctccagagtattccttgaattttcttagctttgtgcaacccacgagcacttaatatatcactaacccttgagtttattggagggagtgaatgaaataatgaatgtcaataacgttacgcaatacctggcacacagtaggtgcttcatcaatgtggcttttcttctcaatcacccaaatgaacctcccccagaatcccacctctagggggacattcctgaaaaataagggactagaatagcgaggtggtgggtgttacccatttatttagatatttgtgtcctggtgaacatggggagggatgcccaagtgtcataaggacaccccctccccccgtctacaaggcagaggtctcttaggatgtgagagagtctctggcaagaccagcccccaccccaccaaggccctcatagaaacagaacattcttcctccctatcccaaagcagaagttgactggggcagataaggcaagtcacattacatctgtgcccttgaccatacctggaccaggcagagaagatcccagacttaggtggtcaacgtttccaccccaagcctctcatttctcgctctctttgagacttgatcttgtaccaggatccactcgacagacttaacgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccagcaagcctgttgtttcttgtgtttagtgcaatgtttagtgagaaaccaatgtctgaattatttatgccaataaaaaatttgagaattactgcattgcactactgccaagacaggtctgaattctattgtt

SEQ ID NO: 10980 - DNA, 5113 bp, Homo sapiens
  ENST00000370060
tcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 10981 - DNA, 4655 bp, Homo sapiens
  ENST00000370055
catcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcc

SEQ ID NO: 10982 - DNA, 692 bp, Homo sapiens
  ENST00000370058
gaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttggg

SEQ ID NO: 10983 - DNA, 3888 bp, Homo sapiens
  ENST00000361699
cgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatc

SEQ ID NO: 10984 - DNA, 608 bp, Homo sapiens
  ENST00000491983
tcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtg

SEQ ID NO: 10985 - DNA, 568 bp, Homo sapiens
  ENST00000474853
atccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtcctt

SEQ ID NO: 10986 - DNA, 570 bp, Homo sapiens
  ENST00000455590
ttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcg

SEQ ID NO: 10987 - DNA, 561 bp, Homo sapiens
  ENST00000496122
acttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaat

SEQ ID NO: 10988 - DNA, 551 bp, Homo sapiens
  ENST00000484652
cgtaaaagttgggtggctgtgaccagaggcgcatctgaggcagagggcagtgtctgaaggcagagagagacacagcctggcgggggcctcagctgggagcagggaagcaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttc

SEQ ID NO: 10989 - DNA, 655 bp, Homo sapiens
  ENST00000439496
aagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaagg

SEQ ID NO: 10990 - DNA, 576 bp, Homo sapiens
  ENST00000407935
ttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagg

SEQ ID NO: 10991 - DNA, 593 bp, Homo sapiens
  ENST00000464967
agctagctcagggacttcccagggcccccaccaggctccctgtctgtcctgcaggccagagccatgcacctcacctgaggccatgggaccctctggacacagacgacgctgcttggtcccagcctccccagagcaacacgtggaggtggataagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggca

SEQ ID NO: 10992 - DNA, 569 bp, Homo sapiens
  ENST00000420165
acagccgctgctgccgcagcatcggcatcgcagacgcgctcgggcggcgggtccgaggccggcgtgcgcggaggctgggcgggcagcccgagcggtggccgcagcgcaggaactccaggcagaacctgagaactgacaggcaggtgtgcagggcacatgtgcagggcaccgctggaggttcccttctcaagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttc

SEQ ID NO: 10993 - DNA, 637 bp, Homo sapiens
  ENST00000458029
gagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgt

SEQ ID NO: 10994 - DNA, 556 bp, Homo sapiens
  ENST00000460553
agacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgt

SEQ ID NO: 10995 - DNA, 740 bp, Homo sapiens
  ENST00000616195
gccgcagcatcggcatcgcagacgcgctcgggcggcgggtccgaggccggcgtgcgcggaggctgggcgggcagcccgagcggtggccgcagcgcaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccagcgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaa

SEQ ID NO: 10996 - DNA, 5004 bp, Homo sapiens
  ENST00000361981
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 10997 - DNA, 462 bp, Homo sapiens
  ENST00000466522
ggctcagtattcacagggaaagctgtgaggggcaacttcctgggagctaaggctactaaaaggtagaagccacagtactcatctgcagagggcttacagcctcagcaaggaccttgtggctttgtaacaacaatcagccataacaagtttacttgtggaaaagaaaaggtgtagcactttcagaagaggctatcaaagaaaagagatgaacttggaagcaagagatacgcagatgagaaaaccaaggcacagaggtgttatgtgatcacacagctagtaagtgctaaacatgagatttgcacctggcagattggtgccagaagtcgtctcttaactgctattctgtactgcctctgtcttttgaaaaagacaatgagaaccctggaaaagtgacaaggaagataaagacaactatcaaaggaatgggaaaacagcataacatttaaaagaaaagatttttgt

SEQ ID NO: 10998 - DNA, 1527 bp, Homo sapiens
  ENST00000247194
cgccccccggacgtggctggttagcgtcccgccctcctcccgcggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtgga

SEQ ID NO: 10999 - DNA, 476 bp, Homo sapiens
  ENST00000463432
gtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaa

SEQ ID NO: 11000 - DNA, 729 bp, Homo sapiens
  ENST00000478430
gtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggtcagtactgtgctgttattatcgtttttcaatagatgataaaacggagaattggagaagttaggtaatttaccagaggttagttagtgagtagcagatccaggtcatgaaggtgggtctctgaacagaccacatgctgttaagcattatattatattgctgtcagacaaagcaaaaggtcaatgaggctttatattataggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaact

SEQ ID NO: 11001 - DNA, 612 bp, Homo sapiens
  ENST00000532049
aaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaa

SEQ ID NO: 11002 - DNA, 689 bp, Homo sapiens
  ENST00000543619
tttttttgttttattttataatagtgttttatttgatataataggatgtgaaagccctgaaaagttgtggaacatcaaatttttgtaatggaataaaattttaaatgtgctaacagctaagtaatgaatcttatctcagtagtaaatgaaatctactacagaatgatctacattcagtaaattattctactcataaagagtcctttaacatagcaaacaatctatcctaatatagctgtttttaagatttggtgtttctgaatattagagtttccttaaggatctctacatcatatagtgatctgaaacatgtgaaaccatttatgttgtatgcaaaaatttggaacatactgtcttcaaaatctgaaatggaacataaaaataacaacatacatttattggatacttcactgtgcatcagtttccaagctaagcacttgatacatgccatctcatttaatcctcacaagaatcctacaaggagctgttatgagaagaatctgggattgcaatgtccccccaaatagagagggagccgagagaccaaagaatgactcagacaagtccaggaagcgaaatgtggtgattttaaagctgttatagtggaagtatcaggacaagcccattacacgggtacagcaagctttataatagaagatgacgacccattgagggatggatttcttctc

SEQ ID NO: 11003 - DNA, 700 bp, Homo sapiens
  ENST00000487285
agaaaggtaaatcactgccaacgtgtgtcagcagccttgcgtatttggtgcgtgtaatttcgattttccctgactcccatccgcctgtggttttgggagacccttgaggagcgaggaattgcgtgttaccctgactcagcgcctccctctgcactggtgaggcattcctagagatttcaccggtggataaagcaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggagctgttatgagaagaatctgggattgcaatgtccccccaaatagagagggagccgagagaccaaagaatga

SEQ ID NO: 11004 - DNA, 758 bp, Homo sapiens
  ENST00000481608
gcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagg

SEQ ID NO: 11005 - DNA, 1355 bp, Homo sapiens
  ENST00000527981
agcgtcccgccctcctcccgcggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcaggtcagtaatactctgccttcataaccaattcccttctctgtggcatggaggaaatatacattattatgtctataaagaaaattaaatgatgtttaaattattaatagtactaagaatagggtacttattaaaatcttaggctctagagcaagcttgtcccacccgtggcctgtgagccacatgcagcccaggatggctttgaatgtggcccaacacaaattttgtaaactttcttaaaacattatgagtttttttgcaatttttttttagctcatcagctctcgttagtgttagtgtatcttatgtgtggcccaagacaattcttctcccagtgtggcccagagaagccaaaagattggacattcctgctctagagcaaaactatctatgagttctagctttaccactggtaacgtatataaccttgggcaagttacgtaacctccatatgcctca

SEQ ID NO: 11006 - DNA, 3296 bp, Homo sapiens
  ENST00000216237
gaatggcgggagcaggcacggaaccggcttttcctccttcctgcagcgtgattggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagccatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 11007 - DNA, 2432 bp, Homo sapiens
  ENST00000481902
aatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccaggtggtcatatcgggtgagtcatgtgctaagttctcttcccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtgtgggctctcgtggccctaagaggctctgactttctttcctcttcttttttccttcttcccccgcccctgtgcccatctccgttctttggcatgaggtggagatgtctcatggaccactttaagtagagagtgagccccgtcacccagcccctgctcctgacttctctgtctccctttccctctggcctgcagagctccttccttcatcttgcccactctgtcatatgttcgtgcccttgtgcacccaggtaaactacccaggtccctctgagcagccctggtaacaagggtgggaagaagggacagctgttctccggcccctcctccagccccgccctctcctcattgcccaggtttggcttcctgtcttggggtgtctcgtgtgggagggtggatggggtctcgggatgcgcctgtgccctgtgtcctcccagggaccctcttctcatctctttcacccttgtctttcaacaacagaaccggc

SEQ ID NO: 11008 - DNA, 751 bp, Homo sapiens
  ENST00000489136
gcgacggggcaggccaatatggcttcctgcacctggtgacgcttggcgaaactgaggtctcatggagaagccccggagtattgagacggagtcttgctctgtcacctaggctggagtgcagtggcgcgatctcggctcactgcaacctccgtctcccgggttcaagcaattctgtctccatctcccatgttcctgggattacaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttaca

SEQ ID NO: 11009 - DNA, 3055 bp, Homo sapiens
  ENST00000466589
ggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtgtgggctctcgtggccctaagaggctctgactttctttcctcttcttttttccttcttcccccgcccctgtgcccatctccgttctttggcatgaggtggagatgtctcatggaccactttaagtagagagtgagccccgtcacccagcccctgctcctgacttctctgtctccctttccctctggcctgcagagctccttccttcatcttgcccactctgtcatatgttcgtgcccttgtgcacccaggtaaactacccaggtccctctgagcagccctggtaacaagggtgggaagaagggacagctgttctccggcccctcctccagccccgccctctcctcattgcccaggtttggcttcctgtcttggggtgtctcgtgtgggagggtggatggggtctcgggatgcgcctgtgccctgtgtcctcccagggaccctcttctcatctctttcacccttgtctttcaacaacagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaa

SEQ ID NO: 11010 - DNA, 531 bp, Homo sapiens
  ENST00000453659
aggccaatatggcttcctgcacctggtgacgcttggcgaaactgaggtctcatggagaagccccggagtattgagagatggggtgtggctgtgttgccaaggctggtctcaaactcctgggttcaagcaatccacctgcctcagcctcccaaagtgctgggattacagatgtgaaccaccgtacccaggctcttcacacgttttctgttacatgctgggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccaggtgccttcagagtgtcccctgaggatggagaggagatagaagattatagaggaagaggggggtggatataggcta

SEQ ID NO: 11011 - DNA, 5875 bp, Homo sapiens
  ENST00000479978
tggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtgagtgccctggagctgagggagggaggccggggagccgggcctggagctgctcctccacctgcttcaccagggcggcttcaggctggacagtgacagtggggaggtctgggcaggagacggatggcgttaccactcgctccatttcatgtttatgtcaaaaaaatcctcctacaaacacttctatcacctgcttggcttcactcccggtctgaagcccttcagtttatttacatgatggaacttggtgctagctgatgtcgaagggtctttgcagtctgaaacccttctctcctttctcccccatttgcagcattttcccatggaaagcagggtgcttctgtagctggcctgggccccgtgggccccgagaggcagatgtggatgctcctggagccacttctgtaaaaggctcctcgatgcggatcatgtaaaagccagaacgaagggcaaggcccttaggggcggggcttgagcgcaagaaccgaatatccagcagctgtgacgtgtggagcctgcaggccgggagagcagagcccacaacagcactcttgttttgtcttcacaccacgtccctaagctccgggaaatccaggaggaggcctctttagtcttgaggaagtagggagtcttttacccagagtaagccacttcctctcctcctttcagaactgccactgaactctggggagtgccctgaacaatgacagctgcttcttgactcagctaactcactcctctcgtctctgaatggctaatgaaggtgcacctccttcctgctggagggggagcctcttttttgccctgaattctctaatagtttcagcattttcatttccagggagttgcatcatccttgtgtctaacacatataatccaatttgctttgtaaaaagcctgcccctgcgtgcctgggctagcgcaactgtgtccgggttctgtgatgaactaaactcaagtgaccagggagatggaatgggatacctcaactggctgaagccagggctgagaataaaaaaggtgaatttggccaggcgcagtggcttacccctataatcccagcactttgggaggccgaggcgggtggatcacctgaggtgaggagttcgagaccagcctggccaacatggtgaaaccccatctctactaaaaatacaaaaattagctggaagtggtggcaggcacctgtaatcccagctacttgggaggccgagacaggagaatcccttgaacctgagaggcggaggttgtaatgagctgagattgcgccactgcactccagcctgggtgacggagcaagactctaaaaaaagtgattctcccaaaggagaatcaaaagtaccattggcaggaaagtgaggattaggtactgggaaggcaactgaaacagtccagtgctgtcctggggcactttattttattttatttattttttcgatatgggagtttcactcttgttgcccagagctggagtgcaatggcactatctcagctcacagcagcctccccctcccaggttcaagcgattctcctgcctcagcctccggagtagctgggattacaggcatgtgccaccaccacgcccggctaattttgtatttttagtagagacatggattctccatgttggtcaggctggtctcgaactcccagcctcaggtgatccgcccgtctcggcctcccaaagtgctgggattacaggcgtgagccaccatgcctggccccctggagcatttcagtaggaggggaggtagagagtaaacttgcaggtggatggctgtgtgtaaacaagggggtcataatgcccacagcccaggtttgtatgatgattgaaggaaagtatatttgtgctaatatcagcgccctgccattgctcgggctggcacagggacgaagggatcgaggctcaccaaggcatcatgtgcccaaaatgatacagtaagaaaccagtcctataaagattttaggactcggttctgtctgactctgggtctctagccatcaccctgcatcccaccacctccacctctactcccggcttagctcttcaaggacaggagacctcatctctttatctctagtagctggttctgcacacagtgggtgatgtgaaaagttgaggtgcaaacgaggacttgactgaggccgtgaggcagtctgtctcccctgctagcacagttagctcactctctcggtacactctcatcgccacacaggtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtgtgggctctcgtggccctaagaggctctgactttctttcctcttcttttttccttcttcccccgcccctgtgcccatctccgttctttggcatgaggtggagatgtctcatggaccactttaagtagagagtgagccccgtcacccagcccctgctcctgacttctctgtctccctttccctctggcctgcagagctccttccttcatcttgcccactctgtcatatgttcgtgcccttgtgcacccaggtaaactacccaggtccctctgagcagccctggtaacaagggtgggaagaagggacagctgttctccggcccctcctccagccccgccctctcctcattgcccaggtttggcttcctgtcttggggtgtctcgtgtgggagggtggatggggtctcgggatgcgcctgtgccctgtgtcctcccagggaccctcttctcatctctttcacccttgtctttcaacaacagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagccatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttg

SEQ ID NO: 11012 - DNA, 3282 bp, Homo sapiens
  ENST00000452106
cttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtaaactacccaggtccctctgagcagccctggtaacaagggtgggaagaagggacagctgttctccggcccctcctccagccccgccctctcctcattgcccagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagccatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 11013 - DNA, 864 bp, Homo sapiens
  ENST00000449635
gagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaaggtcggcagtgagcccttaactgatgtgcctccttccgctcttccatttttctgcatcctgcatgccactcactggagcat

SEQ ID NO: 11014 - DNA, 946 bp, Homo sapiens
  ENST00000450939
gagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtga

SEQ ID NO: 11015 - DNA, 3716 bp, Homo sapiens
  ENST00000499227
aggcgcgagcttcctgcgcctgctcagcagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttggcaggaggagaaaaggaaatgacatcagaggtgctttgctaaagatcacaggaactgcagctgtggccttcctatttcgcagttttccccttaaatctttacacagattcccatcagagtacagtaaaacaaaaattaaatagaattcatatatttgaaatccttggcatcaattcactccaggaatccaagacagtactcaactgaaggggaagcaagcacaagggagatttctgggacactgatactgttccgtttcttcatctgaatgctgcttatgggccttgttcaatttgtgaaaattcatgactttgtacatttatgggtttcactttgtagctcaggctggtcttgaactgctgggctcaaactatcgtcctgcctcagtctcctgagtggatgggattataagcacacaccaccgtccctggcataaaatagttttttaattcacaagatttaataggtagattaaaagaagaggtaagacaaaattaaaagaggtaagacaagagaaggaaaagtcagactgacagattataagttcctatggtacacagtccccttagattggaagaaaggagctaagagggtaaggaagcttggttgccagttttttataactggcagcctggtgatattgggtgtggtagctgagatgtcccaattgtagtcacaaggcctaaaaaagcagatctttacaaatgtttaaaaatactagctcaatgtaaataagcatgaatgttcttgacctccttactgtgccctgaatgtgccaaccacactctcattccaccatctttgctcctgcaatgctgtttgcctgcaggccttcctgccaggagcttgctccttctctctgtccactctggatataacagcccttgcccttctccactttacgctctcttccctttctcttcttgtacctttattttcctgcatagcacccatgattatctgatctatttttttccctttttttttcattctggtgcccaggctggagtgcagtggcacaatattggcttactgcagcctcagcttccctggctcaagccatctgcccaccttagcctcccgagtagctgggactgcaggtgcacgccaccatacccgggaaatttttgtactttttttgtagagacagggtcttgctatgttgcccaagctggtcttgaactcctgagctcaagcaatccacacaccttgacctcccaaagtgctgggattacaggcatgagccactgcacccagcctgatctattatttatttaccagtaccttccctactggaatgaaagctccatgagaacagagtctgttttgttcactgctataccccttgtgccaagaacactgtctgacatataacagtaactggaatatttaatgaatgaatgaatgaatctaggtatatgatggtgggatgaggaaataaagagatagaaaatgtcagtactgtataggtttcagggacaatgaattatcaatacaatgatatattgcctgaatttcagcatatcttagtaactgccttaaagttacagaaggactgagataatctgttagaatgtgaacaataagagcacctacctcacagtatccacataaattgtttagtgcagtgcctggcacagagtaaatgctcaacagttgttagttatgattaagtctgaatagtaactcacacactaaagtaaaattgaggatttgaaacagaaatcaggatttccgttcctcctttgttaaaactaggcacagtattcaacagtctaatcaatttctaaaagtaccatttaaaactgaggtatttagtaaatggtttatagactacttagctctgtaactgaaataaattattctccaaacacggctttcctcaatgagcttaatgaatgttttctgtttaccattattgatgcttttacaaatatctcctatgcctccagaatgatctcggtgccagtgagtcactacaatttcctggattgctgtgttaaattcagttagagcctgctttaaacagctgatgtattctggaattgctggttctccagtgtcaatgaggattctcctgaaaattaaatggaagataatcacacaattggaacactgcgttgacattagcattattttgcacacagataatttacattaaagaaactgcaaaaattattttacttttaacatgcacaaaaaccagctacatcacttcagcttaactacagtaatctcaccctaagaaagttttctgagaaaaattagagctaaatataagtctgaacaaggaataatagcagtcatcttgaacatttacatagcaattaaaataaacatggcaccattccaaggactttacatattttaccaattacattcctcgtaacaactgtttaaagtagatattttatcattatatttagaagtaacttgcccaggttactctacagataaatggcagaaacagctttcaaacccaggtattctgatgccagaatatgtgcttttatctatctgcctttgagatctcatatctcagtatatttcaaaagttttatagatatgaaagattttgattcaatggcacccctaaagaaactagtctttggcactagatatacaacttatcactgaagttttatattagcaccctgacacatgaaaatgaaggctttagtgaagcatgggaaaaacatctgagctattttctttctttacttagacaaccccattagctgtattttttgcttgtggttctgaatcttccttatattttgtttgcccttcctcacgattttatgaggtggcctttctctgtgaagttttgctgaactaaagacatgggggtgacatgttcctcaagatccaattcttttttttttgagacagggtcttgctctgtcacccaggctggagtgcagtgttgcgatctcagctcattgcagccttgacctcctgggcacaagcgattctcccacatctacttcctgagtagctgggactacaggtatgtgccaccatgcccggctcatttttgtattttttgtagagatggtgtttcgtcatattgcccaggctggtctcttaactcctggggtcaagcaatcctcccacctcagcctcccaaagtgctgggattacaggcgttgagccaccatgcccagctcaagatccaattcacaaacttcttcactcatactgtttcacagtaacacctcaataattcaggctggctgacagattagccttgatgaaaagtctgagttattcattaattgatcaataactgtttatggattacctaatatgtgctacaaatttgtttcttgcagtaagcaggacacaacaaccctgcttacattcaactgttggtgagaaggggaactgcatatgactggaaataaacaataaaagtaacataccatagaaagcattttgcaaagcattaaaattaaa

SEQ ID NO: 11016 - DNA, 790 bp, Homo sapiens
  ENST00000519358
gcgcctgctcagcagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttgttttccttctaacaggtccctcagctgtaggtctgttggagtttgctggaggtccactccagatgctgtttgcctgggtatcagcagtggaggctgcagaacagcaaatattgcagaacagtaaatattgctgcctgatccttccctctggaagcttcgtcccagaaggccacctgcctatatgaggattctaccttccctgctaccagccacttcactaactttttctggagagatgacttcaaaatactcaaagtcgcaagataaatacacagaaacgattaacgttgcacagagttgacccagtcattctgtaaattgctgcagaaaaattggatttatttattatatattttacacaaattagaaagaaagcaaagttatttagtaaggtaactatatttgtccagaatcttcctgtgacagtcttcttctgggaacagactttgctcactccagccacaggggtagctgggctaaatgcagtacctaatgtttccttgaccacagggactggtctaaggaatgggtaatgagccagtataaat

SEQ ID NO: 11017 - DNA, 817 bp, Homo sapiens
  ENST00000518553
cagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttggcaggaggagaaaaggaaatgacatcagaggtgctttgctaaagatcacaggaactgcagctgtggccttcctatttcgcagattcccatcagagtacagtaaaacaaaaattaaatagaattcatatatttgaaatccttggcatcaattcactccaggaatccaagacagtactcaactgaaggggaagcaagcacaagggagatttctgggacactgatactgttccgtttcttcatctgaatgctgcttatgggccttgttcaatttgtgaaaattcatgactttgtacatttatgttaatttcccagacaccctacagtgaggggtgacttatgactgaattgacagccaatgcaacagaagacttggtccatgaaaacctcccatgcaatatcccttccatgctcttttctacctgctggattgatcgagctgagcatgcaaccttgaaaaaaaaagccttcaggagggtagagtcacaagatggaaggagcatacatcattacttgcagagggccactggctaactgggaacctttttgggactgtatgggaccaagaaataaatttatttcctatttga

SEQ ID NO: 11018 - DNA, 784 bp, Homo sapiens
  ENST00000518152
gtcacttctacaagtgactaacaccgtcaggataatctaaaactacgaatactacctgactccacaagggtacggtgtattctccagttttagcatctgccttaaaaattacctcagagttaagcactgctggggacttatttctactcttgttttccttctaacaggtccctcagctgtaggtctgttggagtttgctggaggtccactccagatgctgtttgcctgggtatcagcagtggaggctgcagaacagcaaatattgcagaacagtaaatattgctgcctgatccttccctctggaagcttcgtcccagaaggccacctgcctatatgagttctagatccctgaggaatcgccacactgacttccacaatggttgaactagtttacagtcccagcaacagtgtaaaagtgttcctatttctccacatcctctccagcacctgttgtttcctgactttttaatgatcgccattctaactggtgtgagatggtatctcattgtggttaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaccccatcaaaagtgggcaaaggatatgaacagacactctcaaaagaagacatttatgcagccaaaagacacaagaaaaaatgctcatcatcactggccatcagagaaacgcaaatcagaaaaa

SEQ ID NO: 11019 - DNA, 793 bp, Homo sapiens
  ENST00000519167
taaaataggaaacaaaatcatcaggagtggagatagtgtgatgacatttgagaagagaatggaggaaaactgtggaggaatggggaccaggctggtctcagaatcctggcctcaagcaatcctcttgccttggcatcccaaaatgctgggattacagggatgagctatcccaccagggacccctcaggcagattgatttcttatgtgtgttcagctctggaggccacattccaacacctgttgtttcctgactttttaatgatcgccattctaactggtgtgagatggtatctcattgtggttaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaccccatcaaaagtgggcaaaggatatgaacagacactctcaaaagaagacatttatgcagccaaaagacacaagaaaaaatgctcatcatcactggccatcagagaaacgcaaatcagaaaaagactctttaatctatttttttctctctagttaaacattttaagacagagccgttttttataaattctaccctatataagaaacttaacatgcatttatttcctttttcctttcctccaattttcagtttttgttgacaaaactgattataatacttttaaagtatgacaggtattttatttcaaaaattcttatttacatttatattgttttgtaacta

SEQ ID NO: 11020 - DNA, 9657 bp, Homo sapiens
  ENST00000389658
cggggccagggcagcgcggactcgcgtcccgtggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttacacaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccaactacaattctgcaaaaatggctctttacaggttggagtccgtctctctggacatagccagctctaatgccatcgacctggtggtggccgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgtgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgtgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgatcagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgaccgagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccatagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccacgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccgctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctaaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgtaaattgaattccctggctctctttttaaacgtatttttaaaaaaatctttatacacattgaatgttctgttgattacttgatagtattttatgtttttcattttgagctttttaaaaaagtatcaatacagatgataacagatca

SEQ ID NO: 11021 - DNA, 2306 bp, Homo sapiens
  ENST00000492048
acggcccaatccatagattgtaggccccaacacccaggccgcgcattgggctgatgtataatatgcttttggcagagcttctataaggactcattatcaatttacatttagccaggaaagcatgaaaataagtacttcatgtaaagccattgtgcacatatttgttgctttaaaaaaaaaaaaagattcaattcattaggaaaagccagttctggccaaatattttgaatggcagccattgctatttttcatgttctccccttttgctttctctgtttccctggtttaaagtgtgcactctaataatttagaagatggcagaagcattcaagagcaggaccttctgagcagggcgaggctttgagttcggggcagttttcatggtagcatctgcctgtgctgaagcagaaaacagcatctgggacccccatgacttgggcactcttaggacagcccgcagatggttgcgtggggttcaggggcccttcccgcctggctcctcttgtctgcatcctgccctgtcagtgtggacctaggttcacactctgaggccctgcaaaacatgtcacctgtgggcacctccagttttccagtgcctggtccgcagctcgtctcggcagctgcatccttagggccattcccaaaacctcgggtcacggcgggggcctagggggacagcaaggcctttgccccttaagcctgatgaaaatttgtaggagagacttcagtgtccttatgaatttcagtgaagccgagtgggattaaggtgacagacagaagctctaagtgctttcttcagggagataaagcgctggcgagtgcatcatttaaaccgaagatggagtgagcgccaacaggcactggtggttgttgctgttctaatgggattgcttcgtagatggcccttcatggcggaacacgcgtgtgtcagtggggttcgggctgcgggtggcggctgagtgtccctgtgtgtctcttacaggaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgt

SEQ ID NO: 11022 - DNA, 2825 bp, Homo sapiens
  ENST00000488064
attgtagaacctttagaaaaatatagaagaacaccaagtagaaactagccttctagtctttatagatatcaattcaacatttgttattaaatttcgagctcaaataatatgtcttgttctgggttcactgtgaccaccgtgacattgtttgaattccatccatgggaatttcatgttcttgtttgcatctcatgggctggtgatttctgtctttcagtcttttggttttattttttagaacgggccccttgtcagtctcaatgaaaaagatacgaggagattccacttctcttactgaattgtggattttggtaacaacagatgacatttcatttatattagtgtagtgttctagaaagccttcgtgggcatttttggtttcgtagccgatagacctctggctgtggggccagatccagttttctcagtttgactttagaaggtttcagccatccctgacttgaagggaaagggaaacctgggataaagctataacctggggaactgtgttctcttttttacagaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgt

SEQ ID NO: 11023 - DNA, 10374 bp, Homo sapiens
  ENST00000579014
gctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtaagagtatttctttgccattgctgatcttcatcatcttccccaggtggaaaagagactttgtcaagtcttaacctctgtattggagacttttgtaatatttcatttatatccttgttatgccagtagtgtttttatatatatatttcctactctatcctgcttttcttgctcaaaataagatgtcagtcattgttatttatcttgaattcaggggtccattagctatgtaatcctgggtcataatactaactacagatgtgaaaattcagctataactaaagcagctgtctcttgcctgtaggagatgttcagccaatcttttttttttaatttttattttttgagacggagtctcgctctgtcgccaggctggagtgcagtggtgcgatctcggctcactgcaacctccacctcccgggttcaagcgattctcctgcctcagcctcccgagtagctgggattacaggcatgttccaccacacccagctaatttttgtatttttagtagagacagggtttcaccatgtcggccaggatggtctcaatcccttgaccttgtggtccgcctgccttggcctcccagagtgctgggattacagatgtgagccaccacgcctggccgtgttcagccaatctttaattgacttgatatgtagttcttacatgagtccttgtggtgtcctggttataacgtggctctgagagacagcagcgcgaggggggctggagagcagggataatagaaaaagatgacactttgctaagggtactaactactgccaccatcaaaaagatgtttgggcttcctggcttgggatcatcttatcttcctcaaacctaacccccacccccatgcacaaaatcatcgtaatagtcccatcttgagtaaaaagccaataccttcttatttatactattgccaacattgctgttatttctagtaagagaatccagggcaacctctgcctttcaggtgtctccttatgaggatgagccttgccgcccctgtaattgtgaccctgtggggtccctcagttctgtctgtattaaggatgacctccattctgacttacacaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccaactacaattctgcaaaaatggctctttacaggttggagtccgtctctctggacatagccagctctaatgccatcgacctggtggtggccgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgtgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgtgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgatcagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgaccgagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccatagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccacgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccgctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctaaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtg

SEQ ID NO: 11024 - DNA, 4577 bp, Homo sapiens
  ENST00000488089
gatctttttttttttttttgtagttgagctgaaattcatataacctaaaatcgaccatttcatagtgaacaattcagcagcgtttagtgcattcacaatgttacgaggccacctttcctatctagttgcaaacattttcatcactcaaaagcctatgccattaattagtcactccccattctcctctctccccactcctggcaaccaccaatttgctttccggctgtatagatggatttactattctggatattttgtacaaatggaatcatatgatgatgtcttgcatctttcacttagcatgtctttgaagttcatccccattggagcatggatcagtacttcattcctttttatggctgagtaatattccactgtatatacataccacagtgtgttcatcagttacttcatggatgaactttggggcatttctgccttttagctattatgaataaatgctgctatgaacatatgtggataagtatttgtttgagtccctgtcttcagttcttctgggtgtatacttaggagtggaatcactggttatatgataattctatgtttaactttttgaggaactgccaaacttcttctccattagtcttagtaaggttaccttcaaatcaaagtgtgcttactaagtcagcaaaaaggaatgatattagccattgctagcaagggtattgtgagatactcacgttccaattcttctagtgtataaactacctcttttcaatgtgtcgaaaaaaaattaaaagctttaaacattttcacatccttcaaatgtttaattctacttttcataatgttggaaacaacatcacaggcaaaacaattaaacattcacatgtatggtaataaaaagttggaaaatactttaaatttcattgataaaaagacaaattacaatatatctacttattggtatctaatgtagcaataaaccataaatatgaggcaatgcagaatggaaatgtttgaaatcttcagcaataatagcataatgcagaatataaattatatgaacagagattagaaagtaacatacaaaatgtaacattgtgacagctgaagagattcttaaggaattgctctactcacttgatgttaatcttctcacgttatcttcataagatgaaagttttctaaatcatatagtaatgtgttttgtctgggaaattctctatgcaacctccccagcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagtaggagcggcttcctttactatcagtcaggtccagtcagcaaaggagggcctaggacagagggagttaaaatggggccttgctgtaaaggtgcctgcgaaagctggagctggagctggagctggagctgtgctaaaaatcagagcggggacagggagggaaagggtgcctcaagcaactcagatgacacggcccaatccatagattgtaggccccaacacccaggccgcgcattgggctgatgtataatatgcttttggcagagcttctataaggactcattatcaatttacatttagccaggaaagcatgaaaataagtacttcatgtaaagccattgtgcacatatttgttgctttaaaaaaaaaaaaagattcaattcattaggaaaagccagttctggccaaatattttgaatggcagccattgctatttttcatgttctccccttttgctttctctgtttccctggtttaaagtgtgcactctaataatttagaagatggcagaagcattcaagagcaggaccttctgagcagggcgaggctttgagttcggggcagttttcatggtagcatctgcctgtgctgaagcagaaaacagcatctgggacccccatgacttgggcactcttaggacagcccgcagatggttgcgtggggttcaggggcccttcccgcctggctcctcttgtctgcatcctgccctgtcagtgtggacctaggttcacactctgaggccctgcaaaacatgtcacctgtgggcacctccagttttccagtgcctggtccgcagctcgtctcggcagctgcatccttagggccattcccaaaacctcgggtcacggcgggggcctagggggacagcaaggcctttgccccttaagcctgatgaaaatttgtaggagagacttcagtgtccttatgaatttcagtgaagccgagtgggattaaggtgacagacagaagctctaagtgctttcttcagggagataaagcgctggcgagtgcatcatttaaaccgaagatggagtgagcgccaacaggcactggtggttgttgctgttctaatgggattgcttcgtagatggcccttcatggcggaacacgcgtgtgtcagtggggttcgggctgcgggtggcggctgagtgtccctgtgtgtctcttacaggaacagtgtgtggtggatgcagctctggagtacgttcccggcgctcaccagtttggtctcacacaaaacagccatttcatcttgccttttaatcagtcggctgtcagaaagaagtaggtatcattctaacatccttatgcggcgtctcattgctagatgtatgggggtgttctgcagccacagagtcttttccaaaagaacctgcttttattttatgatgaagtgcttgatttgcaaccaaatggcaaagagaaggaattcagtgttggtgcaaatcacaacgctttcatggtggttcactggggagtctgtggtttctgccttttcccttctggagagtggctggcttcccctttctgtgtgcatgtaaggaagcgtgtgggcatctaaattaagtctcctggatctattattgtctggactttcaaccccattccactttaagcattccctagtctgatgtctttgtctacccaaactcttacactgtggtggccaaaatcccgagtgccacacccacccctctctgcaccttctggccctcatacctgcctgtccctgggacccttctgccaagggaagatctcaaggcctggagcttggggctcccggactccatgttgctcctctctcctcctgaggtcctccagctcacctgccaggcttgcctgcagtctctgccatgccctgcccgtcttgttgtcattggctgtgccaccctgtcatacccccttagacctgggctcctgtctgtcttctgcagctcctgccatcactctctgtgaattcaacagctgcctaacacctgacctttctgtgctcaaactgtgatctgtggaaggtctttccctgctccctcctcagccagcctcttccgtggccatacccttgacttcttcacaggtatccatccctctcacagtctcgactttaaaagcctcctattagcacacccctttcttcttgtctccactctgtgcctccccactcctgcagtttctcagctgcatggagacctctaagccgctagccctaatgccctcccaccactatctcccctcttctctagccccaaatcacaattcatcccccagataggttccaggccagtgttacaggtgtcctctgcaaaatcccctaaccctttctctctcccactcctgcgagcccaggtaaaagccaacattccgccttctctgtgccagaacccacacgggagaccaaggccaaggagatggatgtctccttcctagctggtttgagctggatatcatagccgtcaatctcagatggagcctccaaacgacatggggagccagtgcattgctctaatatgttcatggtttttattctccatgactacttcctcatagctgctcttagctcagagccctgtgcaccgcagtccctcttcccaccccagctgatgacttgcctcgttgagaagaaagagctccttcatccgtccaccaccaaaaagaccagcccctgcttttgttcctgaccctctatctcttctgctaccacagatgaagggtacttgttcctagcaaagcccacccagccagccccagcttgtcctctggatcccatccgccctctcctcctaggacatgcacagcagccactcctcacagaccagcacacagatgccgctgtcaccccatcgtcagcagtgacagcaagagcagcaaactattgtgctggaggttgacacaaagatttttacacagatg

SEQ ID NO: 11025 - DNA, 655 bp, Homo sapiens
  ENST00000490190
ccagatccagttttctcagtttgactttagaaggtttcagccatccctgacttgaagggaaagggaaacctgggataaagctataacctggggaactgtgttctcttttttacagaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaagaacgtctaaatcctgttaccgtgcaatatttggagaccctacttgctgtcatacttcatctccctctctctagacattttagagaagtagatctcttttaaggcaaaaggaaaaaaaaaaaaagaaatcatgctttctgcagacttttctggattctcctttgtgtggttagactgaataatgtatgtgcaagttgaaagaccagcatcaagaagtggaatgaaatggcacaggacacacaatggaatccttg

SEQ ID NO: 11026 - DNA, 536 bp, Homo sapiens
  ENST00000484335
actgagatgatctttaagatcctgcccagttgttactcattctaggattccacttcataactgaaaggaaatccagtgattacaaactggcttttttctaatgtggctctctcaaaatttggatctgttagattgaagctcccagagagaagttttgtgcacttggagaatgtattttgcttggtcagcttatatattggttatgtttgtttgcttgtttgcattagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggc

SEQ ID NO: 11027 - DNA, 541 bp, Homo sapiens
  ENST00000585178
gggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtgggaggcgccatctgcgcggcgggatttaatgagcaggtcgtattgcacaagcttggcacgagctgtgtgaggaggaaatgaggatgacttcccgtgacaccactctcatcgctatgcaatgatactgacgtgggtcaaaggcagccgtctgcctctcaagattctttataggtcatgtgcttactcccacacacatttctctatggaaaaaacaggatgatgtggcactagagaa

SEQ ID NO: 11028 - DNA, 1310 bp, Homo sapiens
  ENST00000638611
agataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggcatgagcaagtcgacctggacacctgctggctgtcagaaaggcctaagctggctcccgatgcagaggacaaagctcttgccagagccccgggcttttccagtaggagcggcttcctttactatcagtcaggtccagtcagcaaaggagggcctaggacagagggagttaaaatggggccttgctgtaaaggtgcctgcgaaagctggagctggagctggagctggagctgtgctaaaaatcagagcggggacagggagggaaagggtgcctcaagcaactcagatgacacggcccaatcca

SEQ ID NO: 11029 - DNA, 9640 bp, Homo sapiens
  ENST00000421865
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattctaaataa

SEQ ID NO: 11030 - DNA, 288 bp, Homo sapiens
  ENST00000466230
cggccgcagcagcagcggcagtcacaggcacatcagcaaagaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtttattccctgctgtcctgaatcttgcttctaatgctcttatcacgaccaatgcaacatgtgg

SEQ ID NO: 11031 - DNA, 571 bp, Homo sapiens
  ENST00000498257
ttttctgaaattctcgtctcaggaaaccaccgacactcttagcaaggaagctgaacctcctgggttttgccaacacatttttccatagtttggtaaagaaagaaacctcaaaattctacatgtggttttacttctttataaagtcaagtaagagggtactttaggactgaggtttccatccaagtactccggttttctctccagatatgaacatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgc

SEQ ID NO: 11032 - DNA, 373 bp, Homo sapiens
  ENST00000494137
aacctcctgggttttgccaacacatttttccatagtttggtaaagaaagaaacctcaaaacatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccacccca

SEQ ID NO: 11033 - DNA, 9687 bp, Homo sapiens
  ENST00000618192
ttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacacagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 11034 - DNA, 9678 bp, Homo sapiens
  ENST00000617695
ttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 11035 - DNA, 10661 bp, Homo sapiens
  ENST00000313654
gagcgctgtcagttcctgatccggctggtgcccgctccagccgcggcaggttccagagctgagaggccacccccacgccgcgggcttccagcgcgtggagcaaggggagcggccccggcgccgcccatatccccggctgcgctagtcctggcgctgcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaa

SEQ ID NO: 11036 - DNA, 1815 bp, Homo sapiens
  ENST00000585600
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaaggacccagtgaaaaggtggccatctacaagccagaaagcaggccctcagcagaaactgaaccagccagcacctggatcttggacttcccagcctccagaactggagaaataaatttctattgtttaa

SEQ ID NO: 11037 - DNA, 9834 bp, Homo sapiens
  ENST00000399516
atggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaa

SEQ ID NO: 11038 - DNA, 557 bp, Homo sapiens
  ENST00000591749
acccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctggtatgcttctgttttgcccattgaattttagaagcattttgctgatatctatattttttgaagcttattaaaattttggctggggttgtattactcctataatctgtgaagaattgccagtttaatgtttattcttcccatctagaacctgacttgcctcttcatttgtttgagcattttttgatatggcctaataaaatttagtcatatttaagcacctctc

SEQ ID NO: 11039 - DNA, 590 bp, Homo sapiens
  ENST00000592519
ggcaggccaggtgaacatttacagctgcaactacaggtgcgatgcaatgaactcactgctctcacctcaaaggctgtgtcaagtacctgggtgcatagcacaaggaaaaagactcattctcagtaatgttagggggtgcacacctacctttgcaacacaccttcagaactggggataattaatgtttgatgattgtcaagtggaaaaaaaaattaacaaaggacttcaaaatttgccctgatgaagttcttctcttccaagagcactaactgacaagggcttattaaaaatggttttgtttgcataatatttcaagatgtgtgcaaatgttcagagcatgctgtaattaaagaatcagcacaaggggtgtttccacatgaaattaattgtatactaaatgggactggaagtcagagttccttgaaacagcagatggagcactgcagtaaacccatccagttcttggccatggccttgaacattgtattactactactttcatgttgctttttgtcaaacccaagatgacctgaagcaatggacatcttccctgttgtgaaaatgaaaacaaataaacaaataaacaaaaa

SEQ ID NO: 11040 - DNA, 5671 bp, Homo sapiens
  ENST00000269217
aattacagagcggtgcgcttacctgcgggactgttatgtgcgctctggcacaggctgactcatgtgtgaagtttaaaggtggggcccctgccgcagacagccttcctcacctgagtcaggcaggcccgggcactgagcaggaagggcaggtataagaggaagaggcagaggttcctgcgcagccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtctttt

SEQ ID NO: 11041 - DNA, 5007 bp, Homo sapiens
  ENST00000587184
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaa

SEQ ID NO: 11042 - DNA, 3494 bp, Homo sapiens
  ENST00000586751
ctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctgggctgaggcaagagggttgcttgaggccaagagttcgagaccagtcttggaaacacagtgaaaccatgtctctacgaaaactaaaataaaataaaatgtaaataaataaaattttaaaaataaatcagttggatggataaa

SEQ ID NO: 11043 - DNA, 4921 bp, Homo sapiens
  ENST00000588770
ctcagttgcaatatgaggctgttcagctacaagagctctgagttccctgtggttctgttggacgagattctttgaatagattcttaatgattccttcattcaagtagccatatgcactgcttttagtgttgtcaggttaactgcaggtttttaaaaaactgtatttattatagaatctggaaattaatcagaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagca

SEQ ID NO: 11044 - DNA, 637 bp, Homo sapiens
  ENST00000586709
gaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctctgtaagaatgctcccaaattcttgcatccagtccattctaattgatttgaaacacaacgtgcagagtgcaatgtagagttccccgttataggtggaaggcctcatggtttcagcgaatattactgttagagcatcacgtggtgaaaattggtagcccccaggagtcccaggttaccaacgggctgtagaatataacagcttaccatcatgcaaagaaaaaaaaaaagttcttctaaaagttagata

SEQ ID NO: 11045 - DNA, 771 bp, Homo sapiens
  ENST00000588164
cttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctgggtgagtggaataatacttctgtcagagctgtgagtgagttttactctctttcgtttaatggaattttctggtgtctttttgcaaaatatttgtccttgataccaaaaatacttcactaataagtcttgtccttcttcctttttccatatcaatttcttcataaaaaaataaactgccacacatggtggctcatgtctgtaatcccaacaactaagaaggctgaggcaagagggttgcttgaggccaagagttcgagaccagtcttggaaacacagtgaaaccatgtctctacgaaaactaaaataaaataaaatgtaaataaataaaattttaaaaataaatcagttggatggataaattgtggtgtattcaaatggaatgctatatagcaatgagaaagaaggatctagaactatatgtaatgacatgaatgaccctcacaaacataatgtggaaaacattgagtcacacataaaagttcatctcatat

SEQ ID NO: 11046 - DNA, 473 bp, Homo sapiens
  ENST00000592442
atggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggtaggtgatcctctctttgtgggtaactgatgagaacggcctgcccatgggaagggtatctctttggtccagttaacaaagtcagctttgtcaacatgtgctgcacgagacccgcataccacagtctttcaaaatgccatctttggcaagatacacccattaaaaaacccataaaaaactcctgggcccggcctccttttggaggagcagcgttagcatgtaaccttggaaaagacctaattaaaattaacttcagattatggcccggaaaagtattcactggaattttattgc

SEQ ID NO: 11047 - DNA, 462 bp, Homo sapiens
  ENST00000590104
tggatggactgagggcccgggagggaagtttgcctggaaactccaccatcagcatcagagcgccagtttacctgggatcacctccatcagggaaaccaaaggtgcaggttgagacgcaggccctgaaagggtgaagatagagcttctctgccacttcctaaacctgaatctattggcttctcctccagggaatgcaaaaacgtaggttttaggttatagacagagattttttggttaacataatgtgtttcaaattacagtaatttgtgccattttcaccatctttgccataaggtaaaacattggcttaactgttttctctccatcaaactatttattttaaatgtgcttctatgggatctttttatctctcccataaatggaaacccaatattctttaccataaataatagataaccctgagaaataaacatttgaaaaccaaacactgttaatatcaaa

SEQ ID NO: 11048 - DNA, 554 bp, Homo sapiens
  ENST00000588004
tttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacc

SEQ ID NO: 11049 - DNA, 6547 bp, Homo sapiens
  ENST00000230538
gaatattcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgaga

SEQ ID NO: 11050 - DNA, 6438 bp, Homo sapiens
  ENST00000522006
ttcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaa

SEQ ID NO: 11051 - DNA, 6297 bp, Homo sapiens
  ENST00000389463
agaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaaca

SEQ ID NO: 11052 - DNA, 5983 bp, Homo sapiens
  ENST00000424408
agtcccgaacggccagggagaggaggtggcctagcgctggcggggctcaccccaatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccgg

SEQ ID NO: 11053 - DNA, 694 bp, Homo sapiens
  ENST00000604740
gggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaagtaaagtaacacactatactcctagactcctaatgacatggctgggctccatctttgtttgtcacatgtcatcgttttttcccatctttcctttctgtgccaccttaatcctattatgttatcaccaaaataaacactaaatagtacatgatttatgctatcaaaagaattatattctctgtgactttccaattgtaaggttcataaaacagtattcttccaggatactgtatttgatc

SEQ ID NO: 11054 - DNA, 579 bp, Homo sapiens
  ENST00000521693
cttttcattaaccacatgttccatttcaatttcatgagaaaacctgcttatccaacctagagtgggtcaaggtaaaatgctagctctgtggtatgtaaagaagcctttttcttttgcagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagcc

SEQ ID NO: 11055 - DNA, 587 bp, Homo sapiens
  ENST00000519245
cactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgaggtacaaatcattgtagtttggttggttttgtttttgttctttatacttagatctgttgatctaatcaggcagtcaaatgagacaggcaggatggtaaataaactgagaactttcatatctaaagagcaactgaaggaccctcatcttctcaaccctaggaaaacatttactttaaaacattggatgtatttttcctgttgatgttccaatttaaaagtcactgaaagattccttttaattgcttaattaaccagaaggcttctattaatcttaaatatctcaattggtattcctacag

SEQ ID NO: 11056 - DNA, 1054 bp, Homo sapiens
  ENST00000523765
taaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggtaagcatcagagagaattgaagtctcatctgttgattcactggagtgtaaggtaaaccttcaaggaaggattaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtt

SEQ ID NO: 11057 - DNA, 2725 bp, Homo sapiens
  ENST00000521187
ttttaaagagctgagccaaaaaagcaacagacaaggcaagtgggcattcgaccaaatgccagactaaagaacttctcttcctcttaaatataacccatagatcagtccttcaaatcccaaaagtaagtacatgtcgcccatgctgtgcatacagggtggtgtcctagccttgaatcatttctgtgctcttagatcacattctgtccttcaccacgcacacaaaaacacacacatacacacagacgcccacacaaaccctttcttcagaggccacatttgagttgggcattatttttgacaaatactgtgtgagatctctgaaacagaatctcccaagttgagagaatggaatcagcttctcggagaagagctccattcacgctgagccaaatctgcttgagcagttatttgtacacaagtgccatcaatgttgatgggaatttggaatgaagcactgaaaacagcatgttaggccagtgagaataatccttgaaatctctgtggtaattcaatttcagcagtggttggaccacccaggagccactggaagcatggtgcatttcaaggtctgcctattttttcaacaattttctctttgaaactttaagctcttcagtcagcacaatgtcaaaatgataagcagacatgggcaattttctagtccagcaacttgagatacagtaaaaatttgaagaataaattacatatgaaaggcagttggttgggactgaactgtgactgatgatataggaatagcaccagattttatagcattctgtcattctaaaactggccatcaagtgaagtaacttaggaatggaaaaccaaacattgtatgtcctaactgatacgtgggagctaagctatgaggacgcagaggcataagaatgatacaatggactttggggacttgcagggaagagtggagtggggagggataaaagactacaaatatggtgcagtgtatactgctcgggtgatgggtgcaccaaagtctaacaaatcaccactaaagaacttactcatgtaaccaaataccacctataccccaataacttacggaaaaattaaaaaattttttaaaagtaaaactggccatcacattacctttcatgcattatttttgggatgatttcatgtgttatagaactttcacatgccaggaagatttacgtttaggaaatacattatgcccacccacccctatctgtgcttatacaacattcttttctcatacatttaatctagcctttatacggattatttgtaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgaggtacagcggacactcaccatcaatgcatttcagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagctttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgccagcatcaagaggggccatcttttgataggatgacacatgcatgttcaaacatattttaaaagattagggagaaaagaatactgtgaacaaatagaaaccaattatgagcaaattcacgaattcggttatgtactattgtggctggcaaaagccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttttgctaaatgaatgcatgattatcttatacaataaaagtataacacaaaa

SEQ ID NO: 11058 - DNA, 729 bp, Homo sapiens
  ENST00000521732
aagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaaagcctctgggcatgtgtttgttataatacca

SEQ ID NO: 11059 - DNA, 672 bp, Homo sapiens
  ENST00000368640
tgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaa

SEQ ID NO: 11060 - DNA, 1330 bp, Homo sapiens
  ENST00000521398
aatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaata

SEQ ID NO: 11061 - DNA, 480 bp, Homo sapiens
  ENST00000518842
aagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagtaaaaataacagtacatgattgactaaccccactttctctaatgtgctgcaggtgtgggattaagaaaagctatgcaatatcactctctagaaactgctgagtcccacccctggacttaaccctttctgcacctcagcaaatggagcctgcaccaagtacttggtggtccacttgattccctagggcaaatgggtggtttacatttgcatagctcta

SEQ ID NO: 11062 - DNA, 559 bp, Homo sapiens
  ENST00000524032
ttattcttccttgcaatgataagacagtgttaaaggcatttctgttctcctgaaaagtgaaaggagggaaaaagttatgtaacaaagaagattatatatacatcatctatcactgaatgaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattg

SEQ ID NO: 11063 - DNA, 331 bp, Homo sapiens
  ENST00000423735
tcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaaggccttctccacagagcacgagaggctttccactgaatgactcg

SEQ ID NO: 11064 - DNA, 588 bp, Homo sapiens
  ENST00000519932
aaaagctgaatattcttctggagcccttggaggggctccaaactgagaggggagggaagaccgcagggaaaggcggacctcagtgtctgaaaagccagcttagagtgggagggcctgggagtagaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacagg

SEQ ID NO: 11065 - DNA, 1080 bp, Homo sapiens
  ENST00000431543
aatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgactactgacggagaagacccaggtttttcagcttctgccctatcgttcattctcagctctcagggagccagagaagccagggctccaacatgaacacttcttgtagctcactgtcatgaccagtgtttcagtcagttcttgcaggttgcctgacttacctcatttctctcatttcctgtaagcaaccaaaaataaaaggctttcttttatttcattttgtcttattttgcttttatcttgaaggcatataagacctctgtatctgccttgttcaccttcaactgcttctaattcttcctcaattccagtgtccaatgtcaatttgaaattaaaatttacagactgattttaactaagctgttggtaaagctgacctaagccattcagccacaaaatatagagtatacaaaattatgctaccattttacacatatcaagcaagcaaagagatttttttttactggtggaacactaatctttcaaatatagaatagtggctaaatgaaaataaaacagcttagaaatcta

SEQ ID NO: 11066 - DNA, 541 bp, Homo sapiens
  ENST00000243219
agtcccgaacggccagggagaggaggtggcctagcgctggcggggctcaccccaatccgtctgccttttgatgccgtactgtaagctccgtccatctgtaggttcttgagccagaacctctgcgggaaggagaaaaactgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattc

SEQ ID NO: 11067 - DNA, 539 bp, Homo sapiens
  ENST00000521690
gtctatcccccagaaaaaacccgagaaaccttgctcaagaaagtgggcaccctgaccctctgccttcagagatcatctacctttggttcctgccctggaatcccttttccacccactttcctgcaaactagcgggggccacataaaatatctatctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccct

SEQ ID NO: 11068 - DNA, 1061 bp, Homo sapiens
  ENST00000368638
gggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttgcatttggatgttgagagttgaaagttgaggcttcggaatgtgtctgctcaaaggggtgagagtgcatgtgttggtgctctgagttcatccgctagactctcaccggggactgcagcagcacatcggtgacttctgccacttgcgtgtcccagtagtcattttgtcaagccacggcacttaacgtgtgtgccctgtcactggcttcctgctcctctgtgctgttaggacagtgggaacactactgcaggatctttttgtctcatattagacaagaagtcttctgcagcagggaaggtgagggggtgagtgagagtggctggtcatgaaaggagctgttagacaactgctgagagggtatcttaagtagaaacgagccattgtattccagaaacaagatgtttccattaaaatcaagcctcagga

SEQ ID NO: 11069 - DNA, 645 bp, Homo sapiens
  ENST00000453937
agaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttg

SEQ ID NO: 11070 - DNA, 554 bp, Homo sapiens
  ENST00000455073
gacctcagtgtctgaaaagccagcttagagtgggagggcctgggagtagaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgt

SEQ ID NO: 11071 - DNA, 1540 bp, Homo sapiens
  ENST00000472714
ctttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacttttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaagtacagtgcttttgtatata

SEQ ID NO: 11072 - DNA, 5766 bp, Homo sapiens
  ENST00000393561
ggggctgatcagggtgggcgcgagcgtcggtgggtttcccgggagggaggctctcgctgctggacagacctgatgacgtgtgtgggtttctttccgtgtccttctcctttcggagtccctgccttcccagcctctcctgcgctcatctctccattgtcttttctgtgcattttgctttcttccgaatggactgtcctctctccgcacccactcccccgcccccgcttgttcgtttttttcgggctccactccctgcttgtgtccccccaactctgttgcctgtccttcccgcagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaagtacagtgcttttgta

SEQ ID NO: 11073 - DNA, 5725 bp, Homo sapiens
  ENST00000222399
ttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaag

SEQ ID NO: 11074 - DNA, 945 bp, Homo sapiens
  ENST00000474380
agcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgcacccttgctgaggaccacctacacattctctggggccacccaggccctgcacagctgttttgctgcagcagattcactatccgaagtattgtgcctgatccttggcttgttgcagacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgcca

SEQ ID NO: 11075 - DNA, 595 bp, Homo sapiens
  ENST00000468518
ttttaactcatttgggcagaagatattgatgagttgtaaacttccattgtttccttggaaataagcaggttagtttactcctaaactctctgctcctctctccattctgtctcccaaacactgttttcaagcacccttgctgaggaccacctacacattctctggggccacccaggccctgcacagctgttttgctgcagcagattcactatccgaagtattgtgcctgatccttggcttgttgcagacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacc

SEQ ID NO: 11076 - DNA, 379 bp, Homo sapiens
  ENST00000491196
cagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaa

SEQ ID NO: 11077 - DNA, 449 bp, Homo sapiens
  ENST00000470995
cgaaagcctagacaacactgtgaaagaacttgctgaacaactggaatttatcaaaaactcagatattcgggagatgggctcttgctatgctgctcaggctggtcttgaactcctggactcaagtgatcctcccgtctcagacttctgaatagctgagattatagaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagc

SEQ ID NO: 11078 - DNA, 764 bp, Homo sapiens
  ENST00000468999
attactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtg

SEQ ID NO: 11079 - DNA, 653 bp, Homo sapiens
  ENST00000476039
cagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggc

SEQ ID NO: 11080 - DNA, 304 bp, Homo sapiens
  ENST00000479448
tacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgaggtgagttgtgggcgttctcgcattgacttgatcagagagtggagggaactggggttctacaagagccttctgtaaattataaaacacagtacaaattaacgtgtctataagaacctgtatttaat

SEQ ID NO: 11081 - DNA, 2806 bp, Homo sapiens
  ENST00000393560
ctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggca

SEQ ID NO: 11082 - DNA, 703 bp, Homo sapiens
  ENST00000439976
aaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagaaacagcaggacctggcgcttccctggaatggagaagccttgaaaccactccagagccccagggactgtccatgggctcccctagctccggaaagcggcgtccaccgcgagccccggcgcctcgtccccagcgaagcgccggtgaccctcgcgcgtgcacgcacacgcactctcgcttcccaagctcacagatctccacgcgcacactcacaccgaggatgcgcgggctgccgcgtgcacgcgggttcacgtgcgtggccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaa

SEQ ID NO: 11083 - DNA, 550 bp, Homo sapiens
  ENST00000393559
ttctttgggctcgggggctcccggagcagggcgagagctcgcgtcgccgggtgaggagaacaaagtggctgcacgattttccccactttccagcccaccccccgcttccgtgggagcgacaggaaatggaagggcgcctcttctctctttgaacatttgccttttttcccctcctttccacctctccagaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctga

SEQ ID NO: 11084 - DNA, 689 bp, Homo sapiens
  ENST00000467506
gacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 11085 - DNA, 5674 bp, Homo sapiens
  ENST00000418109
ccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 11086 - DNA, 412 bp, Homo sapiens
  ENST00000484713
gcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccc

SEQ ID NO: 11087 - DNA, 5643 bp, Homo sapiens
  ENST00000305544
agggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaat

SEQ ID NO: 11088 - DNA, 1021 bp, Homo sapiens
  ENST00000498377
agtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaactt

SEQ ID NO: 11089 - DNA, 1092 bp, Homo sapiens
  ENST00000469665
gcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgatta

SEQ ID NO: 11090 - DNA, 535 bp, Homo sapiens
  ENST00000477225
ccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcaga

SEQ ID NO: 11091 - DNA, 563 bp, Homo sapiens
  ENST00000480640
caacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaa

SEQ ID NO: 11092 - DNA, 576 bp, Homo sapiens
  ENST00000538659
ggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgaggtatgggaccctcctgcagatccctggttagatggggccaggtgtctgtcttatctccagggcttagcctcttatagaggctctgaccctgccttgttcccaccccagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatcc

SEQ ID NO: 11093 - DNA, 594 bp, Homo sapiens
  ENST00000542580
agggatgacacatttcttcttcctcctccctgcaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccag

SEQ ID NO: 11094 - DNA, 536 bp, Homo sapiens
  ENST00000462930
agcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgtgagtatgagtgtgggagg

SEQ ID NO: 11095 - DNA, 732 bp, Homo sapiens
  ENST00000464891
ctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctg

SEQ ID NO: 11096 - DNA, 558 bp, Homo sapiens
  ENST00000483057
ctactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgt

SEQ ID NO: 11097 - DNA, 590 bp, Homo sapiens
  ENST00000486298
gattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggg

SEQ ID NO: 11098 - DNA, 559 bp, Homo sapiens
  ENST00000477701
gatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggct

SEQ ID NO: 11099 - DNA, 605 bp, Homo sapiens
  ENST00000493571
gacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccaccc

SEQ ID NO: 11100 - DNA, 343 bp, Homo sapiens
  ENST00000488638
aaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcggt

SEQ ID NO: 11101 - DNA, 408 bp, Homo sapiens
  ENST00000483321
gcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggttagaccctgttatctaatctggggctgaacctctgggtgtgggagcatctcctccatcatcccgttttcccaggtccctgagcaat

SEQ ID NO: 11102 - DNA, 582 bp, Homo sapiens
  ENST00000494831
aactttgctcaaagtcgctggactctaagctgtcggagggaccgctggacagacctgggaactgacagagggcctggagggaaacaggccaaagacccacaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcc

SEQ ID NO: 11103 - DNA, 1309 bp, Homo sapiens
  ENST00000427562
agatgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagcta

SEQ ID NO: 11104 - DNA, 2039 bp, Homo sapiens
  ENST00000246070
tgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 11105 - DNA, 3173 bp, Homo sapiens
  ENST00000445593
atcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagatgaccttgtgattttgtgctgattgtgtctgaggacctttccctccacatatggtctggcagatgcacccagttcagcctaaggagtaggcttttttttgggggggggaggtcgggtgggggggatttttaatcttttaattttcaagatggttaaaatattgaaatgtttaagtggataactatattattcataaaatgactgagtgaaaactaatacactatgagatgaaaagtacttgtcagggattttcaagcttttgctcaagtaattactatgaaataacaatttctagaaatgaagaacaatccgtggagaataaattaccattggtgtgggggaaaaaagccaaacagaagtagaaaaaggtgtagccggcatacaaatgttatctacagtgtatttttagat

SEQ ID NO: 11106 - DNA, 915 bp, Homo sapiens
  ENST00000521545
cgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaa

SEQ ID NO: 11107 - DNA, 618 bp, Homo sapiens
  ENST00000517924
gctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaaaattctttttaatctttcggcagacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatg

SEQ ID NO: 11108 - DNA, 2758 bp, Homo sapiens
  ENST00000619747
atcctattttctgggaaaagattactaccacagtaattgagctgtgaagcggagacaaattgctctcggtggtggttcaaagtactgcaattgactggaatagcaccgcgcagttttccttcctctcgtgcaagataagagtgataggagctgtatcgattacctgcaagatagaagtagaagcgggccgggtgcggtggctcacgcctgtaatcccagcactttgggaggctgaggcgggtggatcattcgacgtcaggagttccagaccagcctgaccaacatggtgaaaccccgtctctactaaaaatacaacaaattagccgggtgtggtggcaagcgcctgtaatcccagctactcggttggttgggcaggagaatcgcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatcc

SEQ ID NO: 11109 - DNA, 4469 bp, Homo sapiens
  ENST00000299213
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttatagattgtgcctgacaaaagtctgtgcctgtctgacagagctgtgggtggtatgtcatgaggccctgaggagcttagcagagacatctttcttttctttaagagaacatttaaaaatttttttatttgtacacatttatgggctacatgagaaactttgttacatgtttataatgcatagtgatcaagtcagggcatttagggtttctcactgtaccccagggcagccccagggctctccttgggcttctggcagcctgagtggtgtctcatcacagggaattttactgagcaaaggcagcttggcgtatactgagggtgtacagtccaggacccacagcattgatctcacctgggaacttattagaaatccagattctcaggccaaccctaggcccactgaattagaaagtctgggagaaaggcctggaatttgggttttaacaaacgctgcaggtgattctgatgcacgctggagaaccactggatggacaaaggctgcaggacttgaggtcagtccatttgacccccaatctctcactattttgtgaccttgggaaggttactaagccccgtgaacctcatcatctccctgtgaattgctttgttacgatgtccatgtctggaatgcagctggccctccataaatgttagctctctttccttctcacttgggttaatgtttgttatcatcaggagctgccttggtgtagcagaaagagcattggcctagattccagtgttggcttatgctctggctatttggcaggatttaatagagcttgttaataattattgaacagtgattaggtgccagggactatgctaagagctttccatgcattatctcatttaatctgcccaaaaactacaagagaaatgttcaggtattatctctattttattccagaaaaaaacagactttacttgggtaattaacttgtctaaggcttaacagctaaattggtagagttgggcttgaaactagtggtctggctttggagcccacactgtttaaccactaagtggtactcaacatttctgatctttactatccatattcaaaaaagaatccaccataaaaggtgctaatatttattcagcaccttcctacgtgctaggcattgggttagacacatttcacttactctcagtgtccatcataaggaattattatgccagtatcacacatgcagctgctgaagtaggaaaataatatcccaaacttgtgaaaatggacaaagatagtatatcctaaatgatatggctctatacaaattagcaggtgattgtgatctggatagtaagatgctttgtcccttaagatgcagaagagttcgtgttaactggcaaatgcctccagcaatgttctggatttgccatttccagcactaccagctgtaggtagcctgaaggcttgtgcctagaccaccaggactcctgaccttgggcaatgtcagggccccctccagccccgccctatgcttccctccctgactctgctcccatcaccccctgcctgctccttccctgcagccactccacctgctccttggccatcgggccatctgggcttcaccagctcttcttggcctgtgacattcaaggctgttccaccctattatgcctgttacacaagtcacagctctatttttagattaaccctcgtggatcatagttacttttaaaaatacctacaccctcacctttacatgtgaatacagatgaacttggccttcctttggtcgtattgccctgtgtgacattataaaagaaccctgaagtgggggtcagcagatctgaggtcgagtcgtggcttttctactaagcaactgtgaccttcagcaagtcatttattttattggttcacagttcttcccacaaaccagtggataacaagaagatgttccttaaataaggtcatatatgtgcaagtgctttctgaatggaaaagtgctttgcaggcattagtcactacttatcctgctgtctgatcatcacctccaaaggcaagcctccttttgctgcaattcttaaccctggcctcacattagagtcacctaaagagcttttaaaaactgcctatggggctgggcacggtggctcacgcctgtaatcccagcacttcaggagactgaggcgggcagatcatgaggtcaggagattgagactatcctggctaatgtggtaaaaccctgtctctactaaaaatacaaaaaaattagccgggcatggtggcacgcacctgtaatcccagctacttgggaggcggaggcaggagaattgcttgaacctgggaggcggaggttgcagtgagccgagatcacgccgctgcattccagcctgggcaacagaatgagactccatctcaaaaaaataaaaataaaaataaacaaa

SEQ ID NO: 11110 - DNA, 558 bp, Homo sapiens
  ENST00000559316
atcatcgccctgcctttcccagtcctgctggctgcgctcagtctttaggtggtagcaggccaggtacagcggacacttgctgatgggggattccaggaggtgggatttcaagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaac

SEQ ID NO: 11111 - DNA, 473 bp, Homo sapiens
  ENST00000560052
gccgcaaagtccatccctacccgccttcccctccccttgcgagtggtcccgcttacccttcactgccatcatcgccctgcctttcccagtcctgctggctgcgctcagtctttaggtggtagcaggccaggtacagcggacacttgctgatgggggattccaggaggtgggatttcaaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaa

SEQ ID NO: 11112 - DNA, 527 bp, Homo sapiens
  ENST00000344870
gaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaa

SEQ ID NO: 11113 - DNA, 964 bp, Homo sapiens
  ENST00000559140
cgtggacgagttggaggacgaggaggagggggcggagactcggggcgccggggacccggcccggtacctcagccccggctggggcagcgcgagcgaggaggagccgagccgcgggcacagaactgcccagctcccgtggcttgagtctcagcaagtgttcagtctgaagcccttcctgctgcccactggcatagagttgaccccagaaaatccctggggttcttcggtgagctgacagagcccagtgggcaggcacccagagcaggaggagatgtagccaagaacaggatccacactatcccctgtttggacccaggctcgcatggcagcagccatcacccgatgtgaatgttctcagctcctggagcctacaggagaaaacccagattcctcaatctgctcattaagatgtgacacccactcacatcatctcctcagcccattgcctcaacagttcacgctgtcaacagttcacgctcccgtgattccagctagttccctgagcatagggggctattttgtgtctacatgcctctgcacccccacctctaggtcctctgattgactgatttctagtcagcctttaaaacttcgctgcctcttctccaccacccccaatccccaccccagagctggctgtgtttcctttcttctctgttgctgtagtactctgtacattttatgcctagcaccttccacaattgtgattctatcattgtgtctccctcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatac

SEQ ID NO: 11114 - DNA, 4281 bp, Homo sapiens
  ENST00000265537
gttgctctcctcccttccccggtcccgcccccgtctgtctgtgtcgactgcggacgctatcgataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatga

SEQ ID NO: 11115 - DNA, 4744 bp, Homo sapiens
  ENST00000415258
gctatcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatgacttcaggacatatgtgtgatcctggaatacaccatattccaatttcagagttaattacaaacagattgaggtattccatcatcatcggaagcattggctgtgtgtctgactccacatggaatgctataaagtgggatacatgtggttcttcttgttccagaacttacagtccatggtagacaacactgatacaggcaaactagcaacagcaattaagtcactggttctcagacttaatactctgcctggtcctcatgcccagatattccaatttaattggtccatggtgtggcttgaacaccaggaatctttaaaactccacaagtgattctaatgggcagcaaagtttgagaatcactggacacattgatgcacttgagccatcatttctatctagttcttcctcttcctaatcttcaggttagcggggataagtttggtccaggaccaagagttggaccaaaagggaagacaggggccagaagtctagagtgctagagccgacttgaatgtactcagtctcattgcacatggcagtgaatatggattaaatataagcccatgaaaatatttggtacaaggaa

SEQ ID NO: 11116 - DNA, 570 bp, Homo sapiens
  ENST00000431023
atcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgatgtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtat

SEQ ID NO: 11117 - DNA, 2800 bp, Homo sapiens
  ENST00000414984
atcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgatgtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctg

SEQ ID NO: 11118 - DNA, 566 bp, Homo sapiens
  ENST00000430399
agtgctcgcctaaaggtggagaacgaggagtagaggagccgcaggccagagcctgtgagcaggtcgttttcacgttagggctcggaggtcctcagaaagatgaggttccagacgagaaatccgcctgaggtcacagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttcc

SEQ ID NO: 11119 - DNA, 804 bp, Homo sapiens
  ENST00000467936
tagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcatcctgtacaactgccatacggaggttttggaaatcttcccgctgcagctgggtcacaggacaagccacacaggaccagctcactaaaagaagtgatgatctctcttctgtgacctccg

SEQ ID NO: 11120 - DNA, 580 bp, Homo sapiens
  ENST00000485461
ttattgaggccagggcttctgggaagtctccccagcctcagctgctgagtaacaaggagaaagctgaggccaggaagctctgggagtacaagaactccgtcatctctcaggctggagtgcaatggcgcaatctcagctcactgcaggctccacctcccaggttcaagagattctcctgcctcagcctcccaagtagctgggattacaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggac

SEQ ID NO: 11121 - DNA, 567 bp, Homo sapiens
  ENST00000474585
ttatccatccatctttacagctctgcgtgccatttgtgaaaaacaaaagctacccaacaacctgggattataaaccaggccaaagtggtgagcacccagcagccatggtctggcttcccaccggctcctcacacagctccaagccaggctgtgttgggatggaagctttggtcctgctctcataagcctccctgttcttagagtgaccccacgcttctgtgcctcggcattgcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccac

SEQ ID NO: 11122 - DNA, 2933 bp, Homo sapiens
  ENST00000395323
ggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 11123 - DNA, 550 bp, Homo sapiens
  ENST00000412933
tgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagtagtttaccatatgagaggtttcaccatgttagccaggatggtctcgatctcctgacctcgtgatccacctgcctcagcatccgaaagcactgggattacagatcttcccagacccgtcagattttgaccgctgctgcaaactgaaggaccgtctgccctccatagtggtggaacccacagaaggggaggtggagagcggggagctccggtggccccc

SEQ ID NO: 11124 - DNA, 494 bp, Homo sapiens
  ENST00000464412
gagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatggagtctcgctctgtcgcccagactggagtccagtggcgtgatctcggctcaccacaagctccgcctcccgggttcacaccattttctgcctcagtctccggagtagctgggaatacaggcgcccaccaccatgcccgcctaattttttttgtatttttag

SEQ ID NO: 11125 - DNA, 559 bp, Homo sapiens
  ENST00000406087
gagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccaggtgaatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccag

SEQ ID NO: 11126 - DNA, 543 bp, Homo sapiens
  ENST00000404397
gagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccaggattgtgaagaaccctagagaatactcgggtatgggatacgccagaagagctagcccttcccagctcacatcttggaaaacagcgtgtgaaccaattagcacctctcagccatgaagaaaacgttgagtcacagccttgtacatgaggttctcagagtgagatgggaccacatagggccaacctgcccagcccctgcctgcaggcggagaag

SEQ ID NO: 11127 - DNA, 485 bp, Homo sapiens
  ENST00000401506
ttttgtttgcatgcaagtctcaacgtcgaggccggcagcagcggggctgagctgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatc

SEQ ID NO: 11128 - DNA, 1689 bp, Homo sapiens
  ENST00000467242
gtttgcatgcaagtctcaacgtcgaggccggcagcagcggggctgagctggtgcggccgcagggtttgcagagctccgggggggtggggggcgggaaacgctctccccacacgtaaccccactaaagccacaagcagcagggcacgcgctgcagcctctcaacccctgccctctccaccgcccctaaaaaccgacgcacattggtgggggccgggactgggaggagccgccttcgccgtgctgaaggggaaggagcccgggccgggcgcggggcgtcggaggtttgccccggactggggatcggagccgggagggatgcagagagaggcaggcccctgactgctgggacttccttgctggcagtttcttccttcctgctctgggttagaggagaagcggccgggggcgagcgccggcagccccggagcgcgctctcaggtgcggacgtggggagctcggccccgagtctccggcaggcgctgagcgaagggaaaaccggcgcaagccgcggcggggtccggcctggcccaagaagcggaaagttcatgcttctcgcttcaacttttcgggccggcgccacagccccgagcgaggaagagccgcccctacgtcagactcttcaccctgcgtgcgctcttctggctcctttctttggaggtcgccagcagcctttccaagacccgggaggaaactgcctttgcagggcccagctcccgaacctaaacttgccgcaaagccccgcatcttctgttagtctccctgcccccatccgtcccagcctggcagtgtttagagaggggactgaacttccctctctcaacagttcaagttcccccaccccgaggcttgtgtacccttcttgtgggtgcccctcccttgcctctcccgtggtgtgtgagcagctaggtgccttattataggtgaagctttgaaggctgttggaggctttgtgcctttggctgctcaaaatttgccaagccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggc

SEQ ID NO: 11129 - DNA, 756 bp, Homo sapiens
  ENST00000407930
gaggccggcagcagcggggctgagctggtgcggccgcagggtttgcagagctccgggggggtggggggcgggaaacgctctccccacacgtaaccccactaaagccacaagcagcagggcacgcgctgcagcctctcaacccctgccctctccaccgcccctaaaaaccgacgcacattggtgggggccgggactgggaggagccgccttcgccgtgctgaaggggaaggagcccgggccgggcgcggggcgtcggaggtttgccccggactggggatcggagccgggagggatgcagagagaggcaggcccctgactgctgggacttccttgctggcagtttcttccttcctgctctgggttagaggagaagcggccgggggcgagcgccggcagccccggagcgcgctctcagccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaa

SEQ ID NO: 11130 - DNA, 510 bp, Homo sapiens
  ENST00000484150
gttttgctgcaagttctgttttgaacacctctcttcctgtctccagacagtcccctgatcccacagcagtgaatgcatgaagagttaggaatgtgaaagcgcgtgtgtttgttgacttttggtctgggtttcttggcagccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaaga

SEQ ID NO: 11131 - DNA, 2900 bp, Homo sapiens
  ENST00000370193
gtccctcccgggctggggttcccaccactctttcgggctccacatcccgggtcggagagaccgagaccttcgggccggtgcggtcattgcagctaggccggcgggaggcgggtgcgccaggagcgcggctcgcagtttggggtgggggcggtggcttttcagtcgcccgaggttcgggtgcaataaaggagcagctaatgtaatttacaaacagctcgggccgaacgcagcgcagcgcccggactgacaggcgcattaggcaggctaattccagccggctcctcctacccccggcccgctaattaatgagcttcccaacttacagccgcctgcattggacagacagagagtgaaagagagggcgagggagagggagagaaggagagagaaggggggagcagagaagagagaagagagagggagggagggagagcgagaacaggaggagagaacagaggcaaagaagagaggaaaaagggagaaaggagagagaaagagaaagaagtgccgctgcagataattgattacaccgcgatcaaggctaacttgttagcaatagtcaattgccccgtctctccgcctccctcgcagtccgggatcggcgccctcgcctcggctcttccaactgcggccgccaggacccggggccaggagccactgccgagccacctgacacctttaaatagcaccggggttggcgaaactggagccccgcgcagcgcgccccggctccggccccggattgctggaagccccagcagcagcggcgcccgcgtcagcgccctcttcccggggccccgcgctgttctcccctcctcagccgccgcgctaatcggccccgcgcccggcccgcgccctgcccagtgcggcctcctttccacccgccgctgcctgcccgcgccgtccggcgcccgagctgcccgcgggctgggtccccgcggcccgagccgccccggccgggaccccgaacaaggccgagatgacttccaaggaggacggcaaggcggcgccgggggaggagcggcggcgcagcccgctggaccacctgcctccgcctgccaactccaacaagccactgacgccgttcagcatcgaggacatcctcaacaagccgtctgtgcggagaagttactcgctgtgcggggcggcgcacctgctggccgccgcggacaagcacgcgcagggcggcttgcccctggcgggccgcgcgctgctctcgcagacctcgccgctgtgcgcgctggaggagctcgccagcaagacgtttaaggggctggaggtcagcgttctgcaggcagccgaaggccgcgacggtatgaccatctttgggcagcggcagacccctaagaagcggcgaaagtcgcgcacggccttcaccaaccaccagatctatgaattggaaaagcgctttctataccagaagtacctgtcccccgccgatcgcgaccaaatcgcgcagcagctgggcctcaccaacgcgcaagtcatcacctggttccagaatcggcgcgctaagctcaagcgggacctggaggagatgaaggccgacgtagagtccgccaagaaactgggccccagcgggcagatggacatcgtggcgctggccgaactcgagcagaactcggaggccacagccggcggtggcggcggctgcggcagggccaagtcgaggcccggctctccggtcctccccccaggcgccccgaaggccccgggcgctggcgccctgcagctctcgcctgcctctccgctcacggaccagccggccagcagccaggactgctcggaggacgaggaagacgaagagatcgacgtggacgattgagcggcgccccgggtcttccgccgccctgggctcctagcgctcgaaagcccaacgcctcccggaccggaccgccgaggggagctgggacctcctctgccaactcccgcctcctcccctgtccccggccccggactcggctcctggcagccgcctcttccctctcgaagcaataaacccaggctggccggccgggccggccgccaccagcggcctccgccgccccggaagccctcgccgtgcaattctgtatggcttctatataaatatttaaacctatatagcgggttcttcccaccgcagcctgatttttcctttcttttattattattttttaaatctcggagatttcgatgttttcaaagctctcgggctgccgggtttgctgagggcgagacagaaaccagggcggggaacactaaccctgcggtctaggggagtggcagctccggctgttttgatttttctctgcatgtggcgaatgcaccggcccgctccttcctcgcctccctcggccttattgcagttgacttctatttcctcgggccttttttcctcatgtgggaggggaagaggtgggcagtcaggtcctgacttgcaagtttcaaaatcgatctttcctccccaccctctgagagaaaagtctgttttcgatgccatttctgcctcctaatgcccactaatgctgtttttaagattcctccctccctcccgcatttcctcggactgactgttggagtccggctcttagggacaatgcagggggaaatccaaccaaccaactatcgaaaacagaacccaaagccctataattattttgtactctttttagaatttttttgcatgtgacagagacagagaggaggccgacccaagccctcacctcacctcctccacagctctgggtctctcttgccacttcgaacaccccactcctacccgacttggccagaggagggtggctggatgtgagtgggctgcgagtgccccttccctgctcctcccttcccctctcctccctagactgtacccaaggcctctttctccaataaataaagtctttgccattttactagaa

SEQ ID NO: 11132 - DNA, 1507 bp, Homo sapiens
  ENST00000264005
ctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagct

SEQ ID NO: 11133 - DNA, 1083 bp, Homo sapiens
  ENST00000573538
gtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagagacagggtctcactgcattgcctagtctggtcacggactcctggcctcaagtgatcctcctgcctcagcctcccaaagtgttgggattacaggggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaa

SEQ ID NO: 11134 - DNA, 348 bp, Homo sapiens
  ENST00000570369
cctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaa

SEQ ID NO: 11135 - DNA, 1240 bp, Homo sapiens
  ENST00000570980
ggcccccacccaccaaggacaagatgcccagcccaggatcggtgagcaggagaggcccatccatgcccggcccctattaggcccagcccccatgcccccagacctatctgttcccaccttggactttggcaataaaggagcgccagactgggtgtttgctctgcagaggcaggggtcagcggccttggcctcagcacctcagcgccttcccttcctcagggaagcctgggctttggctactggggggacagcagggagagggggtgtaagcaggggagggtaagtgtgctttgtacctgggggttgagggtatgggaggtggggggtgggtctggtcactgcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcagga

SEQ ID NO: 11136 - DNA, 842 bp, Homo sapiens
  ENST00000575467
ctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagagatgaggtcttgctatgttgcccaggctggtctcaaactcttcaccttaagtgatcttcctgcctcagcctcccgaagtgctggga

SEQ ID NO: 11137 - DNA, 359 bp, Homo sapiens
  ENST00000576450
ggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagggagtggcaccagggcccagcactgacacagctaccacctactccccaccccctgtaccctgggagctggtctggagagagaaacacagtctggacaagagaaacgctcatcagacaccaccaataaacatcaaacagacacca

SEQ ID NO: 11138 - DNA, 322 bp, Homo sapiens
  ENST00000570396
agccccaggcctggaaggaccgctttattgatggcttcatctctcttggggctccctggggtggctccatcaagcccatgctggtcttggcctcaggagtgcctttgcccagggatgtgcttcactgaggatggatctgccagagctagggccagaccccccgaggccccacctgctcttccctagggagtggcaccagggcccagcactgacacagctaccacctactccccaccccctgtaccctgggagctggtctggagagagaaacacagtctggacaagagaaacgctcatcagacaccaccaataaacatcaaac

SEQ ID NO: 11139 - DNA, 568 bp, Homo sapiens
  ENST00000573846
gacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgagaaggcctcgaacacttaggtccagcgatgggtgagaccaagctgatcctgggcctgccttcattgcggctcctgctcacagtggcctctaggggtgctatctaccactcctgggctggcatgcttgctgtcactggcccccagagcagtgaccctggcctgagcaattagggtggctccttccagagtctgtgtcagtgat

SEQ ID NO: 11140 - DNA, 573 bp, Homo sapiens
  ENST00000575277
taccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggtgagtgtctctgcggatgaccggcttggggtggggcaggtgccccagaccccagctgccctgaccccttccacccgctgcaggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggg

SEQ ID NO: 11141 - DNA, 512 bp, Homo sapiens
  ENST00000480597
gaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttagtaagcttggccctggggggctctgcccagctgctgctctcccagggactgcccgcccagcccccctgtgccccacagctcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaa

SEQ ID NO: 11142 - DNA, 969 bp, Homo sapiens
  ENST00000479767
cctcccgacatgtcgcagaagccctagggactgttccgcagctctagatggcccagtggggaggggctgccctgtgggcattgctgtctgatggcctgaaggcaccgcttggagggacacatgcctggggacagtgggctcacagatgtcttgctgctttgccaccgagcctcacagccatctgctgacctctcagagcccagcaggcccctgcccgggggttcgtggaatgcccctgggggtctcagacccactgctcagctcttggccaggctccgtatctctctagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctgcttctgtagtgtctccaaccactcaagtgctgggactgggtgggggcaggatggagttagaccctgcagaccctggccttcgaggtccgtccccctcagacgtctcccccaacgccatggccggctcttgaaggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaa

SEQ ID NO: 11143 - DNA, 2625 bp, Homo sapiens
  ENST00000482893
actccgccgcgccctgcgggctttcttttccaggcctctgctcctgggtcctgcctccgaggtcaggcagggcctgtggttcctcccgacatgtcgcagaagccctagggactgttccgcagctctagatggcccagtggggaggggctgccctgtgggcattgctgtctgatggcctgaaggcaccgcttggagggacacatgcctggggacagtgggctcacagatgtcttgctgctttgccaccgagcctcacagccatctgctgacctctcagagcccagcaggcccctgcccgggggttcgtggaatgcccctgggggtctcagacccactgctcagctcttggccaggctccgtatctctctagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggtaagtgcagttgccctgtgatggcaggtggaacccggctgtgcacacagctaggccttattgttccccatgctgttccctgcactgttccccatgctgttccctgcactgttctctgtgctgttccctgcactgttccccatgctgttccctgaactattccctgtgctgttccccatgttgttccctgcactgctccctgcactgttccacatgctgtttcctgcactattccccatgctgttccctgcacttttctctgcgccattccccatgcgttccctgcactgttccctgcactgttccccatgctgttccctgcgctgttccccatgctgttccctgcactgttcctcatgctgttccctgcgctgttccacatgctgttccctgcgctgttccccatgctgttccctgcactgttccccatgctgttccctgcaatgctccctgcactgttccccgcactgctccctgcactgttccccatgctgtttcctgcactattccccatgctgttccctgcacttttctctgtgccgttccccatgcattccctgcactgttccctgcactgttccccatgctgttccctgcaatgctccctgcactgttccccgcactgctccctgcactattccccatgctgttccctgcacttttctctgtgccgttccccatgcattccctgcactgttccctgcactgttccccatgctgttccctgcactgttccccatgctgtttcctgcaccgttccccatgctgttccctgcagggttccctgcactgttccccatgctgttccctgcacatttcatgccccagaccttcccattctcccaccaacacactggatcatccttcaaaagcttctgtagtgtctccaaccactcaagtgctgggactgggtgggggcaggatggagttagaccctgcagaccctggccttcgaggtccgtccccctcagacgtctcccccaacgccatggccggctcttgaaggccacagagagatccacgtgctggacaccgactacgagggctacgccatcctgcgggtgtccctgatgtggcggggcaggaactttcgcgtcctcaagtactttagtaagcttggccctggggggctctgcccagctgctgctctcccagggactgcccgcccagcccccctgtgccccacagctcggagccttgaggacaaggaccggctggggttctggaagtttcgggagctgacagcagacactggtctctacctggcggcccggcctgggcggtgtgccgagctcctgaaggaggtgagcctgacccccgaccctggcctgtgctgaagttcccgggcccctggcccagtccctggccctgtcaggagcccccgtggctccgcctcccggccctgggctgggccttctcaccccttcctgtgaacaggacaccaaacaccactggtgggcagctccagagatgagtctgtctcctggtttggaaagagctggaacctccagggtggtgaccctaggctgccaggcagggaccctgggaggctggggtcacggggtgcagagctgggtggggcaggggagcagaaatggcgccttttcttcggtgttctgtgcaggactgccggctgcttctgcccccgaaggtcccgtcggcggcggggcacagatcctgcgggcgctgcctcagggctcccatgttgggcactgcgagaacccagtgtctccctcacctcgctttgtcttggccctagaggctgggcctgttaccccattttgcagattgagaaggcgctcagggagctgggtgctttgcgcaaaaccaggcagcgaggacagaagtcccgccgtgtggccctcatcgaagccccgtggggcctccagagaccacacgggcctgagcccctgcacttctgtgtcgcaggagctgatttaatggagttcctgcctcagaccacaaggttcggagcgcccgcccacccctgcccctcctgggcaccctgcccaccaggtcacctgcacctgctctgaataaactgtgaagtcaa

SEQ ID NO: 11144 - DNA, 867 bp, Homo sapiens
  ENST00000371688
atatgccaggagggtggctgggcaggctgctgtctaggccaggctaacccctgcggtgggcgtgggtgtcaccagggccgatggcgcttgtgcagaaacccacgtctctgagctgccagcagccaagctgtcctgatgacattcccgggtgggcgcacaagcctgcactgtccgtatagaatcggcccaggctgtgcagcaggggaacccggagcccggaccccgccacggaggccaggctgccgtgcaccatcctgggtgtcctcgtggtgctccgggcgcaggtggcagcagccatggaggagctggaccggcagaagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaa

SEQ ID NO: 11145 - DNA, 638 bp, Homo sapiens
  ENST00000612714
atgcctggtgcagcagaggccctccccactgtcactgtcactctggtcgctggcgctgtgcctccggcctccggagctctgactgcccactgcattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtc

SEQ ID NO: 11146 - DNA, 10430 bp, Homo sapiens
  ENST00000635767
gtgacacgtgtcaatcaacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggttcaactgttgatgcaaaatcagaggaagctactaaaatggaaaaaagaaaatcagcattaaacaaagttttggaatctttgtgcatacatcaccagcaacaagttttggctatgttgaaatttctagtccaagagcagaatgctgcttctctttgctgttgtaatacatcatgtgttgtgtcttcagaatctcaaaagcccttaatcgaagatgatttatgtggtctgttctgtagttgtgaatataggctggcagaaagaggttgtttacaaaacgaaaaacaaagccctggtttagaacctctgccagtctgtattaaagatttacattgtttatcttgccaaactgtaactgttgaacacgttaagccagtagtgaatagaggaattgcagacagttataattctcacaggtgctgttctggactgttaccaaacattcactctacaaaatcagcctttcgtagtcctcttttgtcaaaggaagtatgtgatctttcagtcactcttaaagatgcctgtagatctcgaagtccctcacccccaccattatcacctatagaaactgaaggatttgaaaaattgaaagacgtcatctcagagatttcagccttagaaaataacaaacttgaagcaaacattaaccagcctccatctctcacaccagcagaaatcagcagcaataagagtgatcatcaagataaaatacttaaaactaaaaaatccagtaactcttattctttactctcaaatgacagcaataattctactacaaatcatgaaaaaggtgaaactgctgtaatttttcaagatttaatggatcgcattaatgaaaaactaaaatcaatagaaaccacggatatgacaagccttgtaaaattatctagcagtgattataatacatataatgatttaaaattgggagatttcataacatctctcttgcataatgcaaaagccagtgattatagttttatggaattattgagtcaacatgataaaaaggtagaaaataaaattattcagacaagatttcgaaagcgtcaagaaactttatttgcaatgcgcaactcctctgattcacccatgtttagaaggcagtctttacagataaaaagagaacttgctagtcttgatgaaaattttacaagaaaaaaatacaccgaaaaaagttcaaggaaattgacacaaaacaatgagatatcttcatcagacaaaggagaattctatcatgaccaagggccttctttacaaaattctaaaagacttcaaggtaaaaatcatgctgaaacatcattttcaccaaattatgcattacagtcactgcaactacctcttcatagttcagaaactaacttgtcttttaatgaattttcagaaagctttaaaacaacttcccctgagaaaatgagcataagaaagccacaggagaaatctgcagatggaaaacaatttttgcaaaatgataggaaaaatccaaagttaggtaatactcaaactcttttgagaaatgatgtttctggacttttgagcagaactaaacgaaatattgtgcctccagggtggtattctgtatatgtaacaaataattatgtttttaaaaaatcccctaaagccaaaaaagtatccgaatccacaacaaaaaacgatccagtgaaaaatattcacattgaaagctcacacaatatagacctaaacaaaattgcaatgaattctaatttacaagtggttgtgaagcgtttggaagatacaataagtatagccaaaaaatcctggaataatcagccattatcagaaggatataaagcatccaagaaattgatagaaattgatggtaaagaccaacatgctgacagaaatatgactcttactctaaatagaatgacatgcaaagaacagagcttatcaaaatctgtggtagcatccggcaatattatcaatagtcactgcatgcctacagtggatttgaataacaaaagacttgaaaatctgaaaaagtcatctattttagatatgggtcgcttgatttccagtgttgaaaatgtaccagcaaaatatgaaggtactgaaagttcatctgtttccaactattctagtcctatcaaactcatgtttttatctgaggttaaaagtagtgaaggggtcaaatatactttaacttcagttggcacttcccattcaaatgttgttctcccttctgaaaaacctacaacccatcacgtaactgaagaaaaaacagaaacaaatgaggatatctcaaatgcgaactctgaaaattatcactccagtcattatgatactgatacttttcaaagagaactaaacaaattcagtcatgcaaaagaaactgcaggatcctctacaatgtttataggtgatataaatagtgataagccacaagaagaacctaaggacaattcaagcagtgctactgatccatcttttaaaagaaaaccaggtagaccaaaaaaaataggtccccaagttgtgaaacagattaagcgaccaattggaagaccaccaaagcctaaaattgatcaaacaaacatcactgtttgccagaatgagccctttagtgctggaaggaaaagcccagaatgtctcatatcagaagtaaaagaaggtatttataaaaagagtattacagtaactgttatttacggaaggtcaagaagaactaaaaggcatgtttctgaaggaagggtaaacataagcaaccttatgtctttaaacaataatgctggtgattttccaactgaatataatagtcccagaaatattagtgaagacaaaattgacttgggtgaaagaataagtgctgtagcaagcttgactactgaaagtgagatcttggggtctggctttgaatatgtgagacccatcaagaacaaatctgtgatacctcagccttccaagaacattattcgaccaaatcagaagcctttggcaataagtaggaagcctggtagaccggcaaaagtgaaaatctctggcatatctgtgactattaatagaacttcacctcaggaaagagaagtaagtattagcagctgcttgcctcctttagaacaggataatacgtcaggaaaaaatctgcctgaagaaaagtatgaccaacagtgcactcaaatggataaaataaggcacactgaagctgatatatttaaaaatggatcaaaacgtatgattgctactgtacctttgagacattctattagggatagaaaaccatctctgcatttcttacattcattagcatcttctagctcacttatttatagaaacgctctgctccataaatcatataaactgcatttgcagaaaaataaaagtcagaaggaaaaacataggcactcaaagatgaaaatagcttacaaagataccccaagaaacagactttcgcggaatgcaaaaaagtgtttggaagataataaattagtacctatttctgaagtatccttggatcctataatttcatcaaaccctttgctcaggtggtgggctacttctgcttcaaatgattccttattagaggaattaaacaatagatttgagcaaataacaaatgcttgggtgcaagtaagtggagatgaagctgaaaattgtattcataaaaaaagagaacacattgaaaatgatcatttcaaagtagcaagccctttggaaacttgtcttttagaacttgaagtttcacctgtaaaaatgctttttcagaaaaagtatgatttgaatgaactctgtacttggtttatgcaaacaacagaaacacagtctctttcactagttagaaaagcaaatgcccgaaaccctttggaagtaataaataccaggggaatcaaattagggaccaaatattctgactttaatgccagccccttcagaaagcactttaaaaaatttgcactctcttctccttcaaaatcagcagagaaattgcatatactgcataaagtggctaactctccactcttaaatgtgaaaagtaatttagcaatagctagattaaaaaggactgagtttaagaggttgcatcatgaaaggtggaaaagagagggaaagctgcacaaccatggaacagttgactggaactctaaaaggagaaacttaagatttttctgccagaaccaatttttaaataagactgagggagaaacaaatgctgacatcccactccaaggaaaaagcatagtagataatcagtgtgttttgccacctgagatcaggggtgacttgcagcagagggtagtaatgcctgacttcaaaatacatgctagttttgagaataaatttaagtcagaagcaaaagagaatggaacaaattgcagccaaaaagactttcaaaagggaccaagactagaaaatgtatgtcctaatagttggaggtcaaaaaccttaaaagactgtagaatatttttgaggaagctcaactgtcttgaacacagaaatacttttaagctaaatacaatcatttactctcctgaatctactgacagtggaaatactcatcagactcatatggaagaatcaaagcgctttactttaagatctcattctgctaggcaaaattcttttaaaaagcaatctaaagaaatagaaaatgctaacacaaataatccttcagctgatgaatttgctgaccatcttggcaatagtaaattaagcaaatgtgttaactttgacaagaatcctgatagttttgaagttcttagcaatttgaacaaaagaaaaagaccaccatggaagatcacagaaatgtcaacaaaaagacataaacgacagtcttgcaacagtggacaaatggcaaactatttttccaaatccctagcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgtgagcttatcagttctttctctgtattttaaatctaagtctgtgggctttaagagcaatggcacaattgcatgtttactgttcagcaaatctgtgcctcttgatagagaaaaatactatgtggtttctgtaagttaccagttttgaatgaaaaatggtaaatggatttacatctgttttattgtaccttagccttttattttaaagttaaagggatgacttttaaaagcaggacattccctacctttaatagtgcaaagcacagtttcagcaatggctacatgactatgtctaaaaactgaatactcagaatactaaaggtttggtgcttaaatttatttttcccatgccagagaaagcaagctttggtatggtaaaccacatgagaacatggctcctttctttttggatagcctggccatgtgtgaatgggattttagcttattatgtttctaagacttttccttacagcacacttaatgtaccttttcagtccttctcccaaccccctgcaaattgtctttaaaacaacaacacataaggaatctgaagcacaggagaacacagagccaacaaacagaatgaagaacaatcatctatttttaactgactttctatcattaccatttttccttttgcttaataactatcttgctttgaaactttgactccttttataagttctatgaggcacatatgtatagcaatttggttctaaaaaccagtgatcttactttagctccatcttaaaatttcaccttaagtaaatggcctctagtagatgataagcctaaaaaaagcacaattattaaaacaaacagatccatgttaggacatttctgaataataaagagaaaaggtgtttcgttgggtattgcagaaaagaggaccaatttcatatagtacaagtttcgtaagtcaggccaagtgtcaatttcaaaagacaagaaatgaaattgacagtgaatagtgctcataaattggtagcgtatataaagagaagttcctgtcacattatattcccactagaattattatccacagtaaataaatattattttgttatgccaaaaatatagcgagcagcttcatggttaataatacatttatgttgacacctccctaatccaggaaacattcacaaacaaggactcccatatacaaatactttaggaagagagatttcccaggcagatatcaccaaaaatgttttcactgtaggaatcacaaaataagtttttgtcaaaataactgttgttgaacgttatactggtcttcctcactggtgattgataagctcctttctagccagtttgtggtacttccttcattttccctagaaatgttacttgttaaatgtgtcctcaggcggtttcatctttgttgattctgcccatctaagtcataagcttctcaaatgcaagctactagctagttacacttgtaagttttccataatgacatgattttaaacataaagagttcataagaatcacttggagagactatttaaaaatgagattcctaggcccacctcagattgtgataaatctgtgtgactgactgatgcacactttttctggactataataactgatgctgctctactgctttaatacaggccaaagtaacgtggaagcgcacagcagaaaatcttcagaaagacatcaggtttgttctgattttgacaagggtaacttcttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcactaaatagatgttgaaaatacacgaatttagatacaagctttaaaaccagtttatttataaataaaacttttttgtttctgactcacattctatcagtgtttaattgatagcctgattccattgacttagcttaaaactaaaatctcaatgtcaaaaaaacactgacttggctatctagcaaagtgaatcagggaaaatctagctaatgattttatatactataacagaacctggtgttatacaggaaaaaaagccacaaacttgtaatgaagcttgtaattaaacgaggaccataactgtccaaaagagatttctttgaaactcaagaagtgacaaaaaaattaagttctctctcttgatttaagcaataaattccaaaaacatagtaaaaaacaagtttccccccaaaaaagacaaatttaatcaacagtgtaaaactatgtactgaaaatacacacaatacaattttgcaaatgaatacaagacagctaccaactttcagctctaacagtggcttgactgacagaagccaaaaataaaacactctaccacacaatatacccaaattatagacagaattattctatcagtatgtaagtgtagagaacccaaatattatcaaaatcaagagtttgctaactgaagatcaaagaggagtcacatcatgtaattaaaaattgaaacaacatattaaagatagtactaaagaccatgccagctaataggcaaaagcaaacacgccgtaagaagtcaaatgctcttgatgatggaattttagactatatacctaagacagctatttatagttttcactatcttgttatatattctctctcattcgcaagaaaattagtttttttctacttgtagaaataaaaagtgaagataggcctccatatattctagacatgcatgacatacctttcagagtcggcttcagcagtctgacacctcctgttcgtcctagctgaaactgtcacttttctctgtccttgaagatagtataattcattatcaggatttattatcagttgctttttgtttttaatctagtttctaggctaactaaatcctttgtcttcaacacaacaatcctttcaacacatgtatctcctacttgttctagccatcttggtaccagttatcactgccacagaaaaaggaacccaagcaagattaaaacttaatttattttgtaagcactaataatgagtaagggaaaataaggaaatttcaagcaagttaaaagaaggcaaattttagttcaatgtatttgaggacagtatatgaaaaatgtgttataatgaagtacctctattattgctatagcacaaagtctgtggagactcatgaaaattaagggttagaaaggtaggttaggtgcataaacaggtgctaaagaaacaacttttttttttcttggaaggtgataaaacatagtaaggtaataatggcttcttgtaaaataacatacatgaccaattcaaatgtgttctaaaatatatttcaatgtaaaaactagaacctttatatactggggattataagattctacttactagaaatttacaaggttaaggagtaagacaaagtttggcttgtgatgtttctcatttataaggaataaaacaatatgaatatatgaagtttggtctattaaaaaggatggtgttctcatggtgtgatataccacaaaaaaaatctgatcaaaaccaaactgttcaatgtgacagtctgaaaattatatactctacttcattcatgttacacttttttctactccttacctgcttttactaatgcatttatccccaagaaaacatccaacaatatgggactaatttggaacaatatccagcaattggtatttaaataatttactggttacaaaacaatattatgaccagactccattttagaaaaaattaaatctgcatcgaaaagggccttaaaaaatagatttctaaaatcaaaatcatggttggctcatgggtgggattattagtgttccttatagtagtttgtctggatgtactttctgattcttctgtaataagcatgcattgcttttgtaatgaggaaataataaaacaataaaaaga

SEQ ID NO: 11147 - DNA, 5604 bp, Homo sapiens
  ENST00000326877
gtgacacgtgtcaatcaacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgtgagcttatcagttctttctctgtattttaaatctaagtctgtgggctttaagagcaatggcacaattgcatgtttactgttcagcaaatctgtgcctcttgatagagaaaaatactatgtggtttctgtaagttaccagttttgaatgaaaaatggtaaatggatttacatctgttttattgtaccttagccttttattttaaagttaaagggatgacttttaaaagcaggacattccctacctttaatagtgcaaagcacagtttcagcaatggctacatgactatgtctaaaaactgaatactcagaatactaaaggtttggtgcttaaatttatttttcccatgccagagaaagcaagctttggtatggtaaaccacatgagaacatggctcctttctttttggatagcctggccatgtgtgaatgggattttagcttattatgtttctaagacttttccttacagcacacttaatgtaccttttcagtccttctcccaaccccctgcaaattgtctttaaaacaacaacacataaggaatctgaagcacaggagaacacagagccaacaaacagaatgaagaacaatcatctatttttaactgactttctatcattaccatttttccttttgcttaataactatcttgctttgaaactttgactccttttataagttctatgaggcacatatgtatagcaatttggttctaaaaaccagtgatcttactttagctccatcttaaaatttcaccttaagtaaatggcctctagtagatgataagcctaaaaaaagcacaattattaaaacaaacagatccatgttaggacatttctgaataataaagagaaaaggtgtttcgttgggtattgcagaaaagaggaccaatttcatatagtacaagtttcgtaagtcaggccaagtgtcaatttcaaaagacaagaaatgaaattgacagtgaatagtgctcataaattggtagcgtatataaagagaagttcctgtcacattatattcccactagaattattatccacagtaaataaatattattttgttatgccaaaaatatagcgagcagcttcatggttaataatacatttatgttgacacctccctaatccaggaaacattcacaaacaaggactcccatatacaaatactttaggaagagagatttcccaggcagatatcaccaaaaatgttttcactgtaggaatcacaaaataagtttttgtcaaaataactgttgttgaacgttatactggtcttcctcactggtgattgataagctcctttctagccagtttgtggtacttccttcattttccctagaaatgttacttgttaaatgtgtcctcaggcggtttcatctttgttgattctgcccatctaagtcataagcttctcaaatgcaagctactagctagttacacttgtaagttttccataatgacatgattttaaacataaagagttcataagaatcacttggagagactatttaaaaatgagattcctaggcccacctcagattgtgataaatctgtgtgactgactgatgcacactttttctggactataataactgatgctgctctactgctttaatacaggccaaagtaacgtggaagcgcacagcagaaaatcttcagaaagacatcaggtttgttctgattttgacaagggtaacttcttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcactaaatagatgttgaaaatacacgaatttagatacaagctttaaaaccagtttatttataaataaaacttttttgtttctgactcacattctatcagtgtttaattgatagcctgattccattgacttagcttaaaactaaaatctcaatgtcaaaaaaacactgacttggctatctagcaaagtgaatcagggaaaatctagctaatgattttatatactataacagaacctggtgttatacaggaaaaaaagccacaaacttgtaatgaagcttgtaattaaacgaggaccataactgtccaaaagagatttctttgaaactcaagaagtgacaaaaaaattaagttctctctcttgatttaagcaataaattccaaaaacatagtaaaaaacaagtttccccccaaaaaagacaaatttaatcaacagtgtaaaactatgtactgaaaatacacacaatacaattttgcaaatgaatacaagacagctaccaactttcagctctaacagtggcttgactgacagaagccaaaaataaaacactctaccacacaatatacccaaattatagacagaattattctatcagtatgtaagtgtagagaacccaaatattatcaaaatcaagagtttgctaactgaagatcaaagaggagtcacatcatgtaattaaaaattgaaacaacatattaaagatagtactaaagaccatgccagctaataggcaaaagcaaacacgccgtaagaagtcaaatgctcttgatgatggaattttagactatatacctaagacagctatttatagttttcactatcttgttatatattctctctcattcgcaagaaaattagtttttttctacttgtagaaataaaaagtgaagataggcctccatatattctagacatgcatgacatacctttcagagtcggcttcagcagtctgacacctcctgttcgtcctagctgaaactgtcacttttctctgtccttgaagatagtataattcattatcaggatttattatcagttgctttttgtttttaatctagtttctaggctaactaaatcctttgtcttcaacacaacaatcctttcaacacatgtatctcctacttgttctagccatcttggtaccagttatcactgccacagaaaaaggaacccaagcaagattaaaacttaatttattttgtaagcactaataatgagtaagggaaaataaggaaatttcaagcaagttaaaagaaggcaaattttagttcaatgtatttgaggacagtatatgaaaaatgtgttataatgaagtacctctattattgctatagcacaaagtctgtggagactcatgaaaattaagggttagaaaggtaggttaggtgcataaacaggtgctaaagaaacaacttttttttttcttggaaggtgataaaacatagtaaggtaataatggcttcttgtaaaataacatacatgaccaattcaaatgtgttctaaaatatatttcaatgtaaaaactagaacctttatatactggggattataagattctacttactagaaatttacaaggttaaggagtaagacaaagtttggcttgtgatgtttctcatttataaggaataaaacaatatgaatatatgaagtttggtctattaaaaaggatggtgttctcatggtgtgatataccacaaaaaaaatctgatcaaaaccaaactgttcaatgtgacagtctgaaaattatatactctacttcattcatgttacacttttttctactccttacctgcttttactaatgcatttatccccaagaaaacatccaacaatatgggactaatttggaacaatatccagcaattggtatttaaataatttactggttacaaaacaatattatgaccagactccattttagaaaaaattaaatctgcatcgaaaagggccttaaaaaatagatttctaaaatcaaaatcatggttggctcatgggtgggattattagtgttccttatagtagtttgtctggatgtactttctgattcttctgtaataagcatgcattgcttttgtaatgaggaaataataaaacaataaaaaga

SEQ ID NO: 11148 - DNA, 9431 bp, Homo sapiens
  ENST00000637787
gggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaaggattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggttcaactgttgatgcaaaatcagaggaagctactaaaatggaaaaaagaaaatcagcattaaacaaagttttggaatctttgtgcatacatcaccagcaacaagttttggctatgttgaaatttctagtccaagagcagaatgctgcttctctttgctgttgtaatacatcatgtgttgtgtcttcagaatctcaaaagcccttaatcgaagatgatttatgtggtctgttctgtagttgtgaatataggctggcagaaagaggttgtttacaaaacgaaaaacaaagccctggtttagaacctctgccagtctgtattaaagatttacattgtttatcttgccaaactgtaactgttgaacacgttaagccagtagtgaatagaggaattgcagacagttataattctcacaggtgctgttctggactgttaccaaacattcactctacaaaatcagcctttcgtagtcctcttttgtcaaaggaagtatgtgatctttcagtcactcttaaagatgcctgtagatctcgaagtccctcacccccaccattatcacctatagaaactgaaggatttgaaaaattgaaagacgtcatctcagagatttcagccttagaaaataacaaacttgaagcaaacattaaccagcctccatctctcacaccagcagaaatcagcagcaataagagtgatcatcaagataaaatacttaaaactaaaaaatccagtaactcttattctttactctcaaatgacagcaataattctactacaaatcatgaaaaaggtgaaactgctgtaatttttcaagatttaatggatcgcattaatgaaaaactaaaatcaatagaaaccacggatatgacaagccttgtaaaattatctagcagtgattataatacatataatgatttaaaattgggagatttcataacatctctcttgcataatgcaaaagccagtgattatagttttatggaattattgagtcaacatgataaaaaggtagaaaataaaattattcagacaagatttcgaaagcgtcaagaaactttatttgcaatgcgcaactcctctgattcacccatgtttagaaggcagtctttacagataaaaagagaacttgctagtcttgatgaaaattttacaagaaaaaaatacaccgaaaaaagttcaaggaaattgacacaaaacaatgagatatcttcatcagacaaaggagaattctatcatgaccaagggccttctttacaaaattctaaaagacttcaagaaagctttaaaacaacttcccctgagaaaatgagcataagaaagccacaggagaaatctgcagatggaaaacaatttttgcaaaatgataggaaaaatccaaagttaggtaatactcaaactcttttgagaaatgatgtttctggacttttgagcagaactaaacgaaatattgtgcctccagggtggtattctgtatatgtaacaaataattatgtttttaaaaaatcccctaaagccaaaaaagtatccgaatccacaacaaaaaacgatccagtgaaaaatattcacattgaaagctcacacaatatagacctaaacaaaattgcaatgaattctaatttacaagtggttgtgaagcgtttggaagatacaataagtatagccaaaaaatcctggaataatcagccattatcagaaggatataaagcatccaagaaattgatagaaattgatggtaaagaccaacatgctgacagaaatatgactcttactctaaatagaatgacatgcaaagaacagagcttatcaaaatctgtggtagcatccggcaatattatcaatagtcactgcatgcctacagtggatttgaataacaaaagacttgaaaatctgaaaaagtcatctattttagatatgggtcgcttgatttccagtgttgaaaatgtaccagcaaaatatgaaggtactgaaagttcatctgtttccaactattctagtcctatcaaactcatgtttttatctgaggttaaaagtagtgaaggggtcaaatatactttaacttcagttggcacttcccattcaaatgttgttctcccttctgaaaaacctacaacccatcacgtaactgaagaaaaaacagaaacaaatgaggatatctcaaatgcgaactctgaaaattatcactccagtcattatgatactgatacttttcaaagagaactaaacaaattcagtcatgcaaaagaaactgcaggatcctctacaatgtttataggtgatataaatagtgataagccacaagaagaacctaaggacaattcaagcagtgctactgatccatcttttaaaagaaaaccaggtagaccaaaaaaaataggtccccaagttgtgaaacagattaagcgaccaattggaagaccaccaaagcctaaaattgatcaaacaaacatcactgtttgccagaatgagccctttagtgctggaaggaaaagcccagaatgtctcatatcagaagtaaaagaaggtatttataaaaagagtattacagtaactgttatttacggaaggtcaagaagaactaaaaggcatgtttctgaaggaagggtaaacataagcaaccttatgtctttaaacaataatgctggtgattttccaactgaatataatagtcccagaaatattagtgaagacaaaattgacttgggtgaaagaataagtgctgtagcaagcttgactactgaaagtgagatcttggggtctggctttgaatatgtgagacccatcaagaacaaatctgtgatacctcagccttccaagaacattattcgaccaaatcagaagcctttggcaataagtaggaagcctggtagaccggcaaaagtgaaaatctctggcatatctgtgactattaatagaacttcacctcaggaaagagaagtaagtattagcagctgcttgcctcctttagaacaggataatacgtcaggaaaaaatctgcctgaagaaaagtatgaccaacagtgcactcaaatggataaaataaggcacactgaagctgatatatttaaaaatggatcaaaacgtatgattgctactgtacctttgagacattctattagggatagaaaaccatctctgcatttcttacattcattagcatcttctagctcacttatttatagaaacgctctgctccataaatcatataaactgcatttgcagaaaaataaaagtcagaaggaaaaacataggcactcaaagatgaaaatagcttacaaagataccccaagaaacagactttcgcggaatgcaaaaaagtgtttggaagataataaattagtacctatttctgaagtatccttggatcctataatttcatcaaaccctttgctcaggtggtgggctacttctgcttcaaatgattccttattagaggaattaaacaatagatttgagcaaataacaaatgcttgggtgcaagtaagtggagatgaagctgaaaattgtattcataaaaaaagagaacacattgaaaatgatcatttcaaagtagcaagccctttggaaacttgtcttttagaacttgaagtttcacctgtaaaaatgctttttcagaaaaagtatgatttgaatgaactctgtacttggtttatgcaaacaacagaaacacagtctctttcactagttagaaaagcaaatgcccgaaaccctttggaagtaataaataccaggggaatcaaattagggaccaaatattctgactttaatgccagccccttcagaaagcactttaaaaaatttgcactctcttctccttcaaaatcagcagagaaattgcatatactgcataaagtggctaactctccactcttaaatgtgaaaagtaatttagcaatagctagattaaaaaggactgagtttaagaggttgcatcatgaaaggtggaaaagagagggaaagctgcacaaccatggaacagttgactggaactctaaaaggagaaacttaagatttttctgccagaaccaatttttaaataagactgagggagaaacaaatgctgacatcccactccaaggaaaaagcatagtagataatcagtgtgttttgccacctgagatcaggggtgacttgcagcagagggtagtaatgcctgacttcaaaatacatgctagttttgagaataaatttaagtcagaagcaaaagagaatggaacaaattgcagccaaaaagactttcaaaagggaccaagactagaaaatgtatgtcctaatagttggaggtcaaaaaccttaaaagactgtagaatatttttgaggaagctcaactgtcttgaacacagaaatacttttaagctaaatacaatcatttactctcctgaatctactgacagtggaaatactcatcagactcatatggaagaatcaaagcgctttactttaagatctcattctgctaggcaaaattcttttaaaaagcaatctaaagaaatagaaaatgctaacacaaataatccttcagctgatgaatttgctgaccatcttggcaatagtaaattaagcaaatgtgttaactttgacaagaatcctgatagttttgaagttcttagcaatttgaacaaaagaaaaagaccaccatggaagatcacagaaatgtcaacaaaaagacataaacgacagtcttgcaacagtggacaaatggcaaactatttttccaaatccctagcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgtgagcttatcagttctttctctgtattttaaatctaagtctgtgggctttaagagcaatggcacaattgcatgtttactgttcagcaaatctgtgcctcttgatagagaaaaatactatgtggtttctgtaagttaccagttttgaatgaaaaatggtaaatggatttacatctgttttattgtaccttagccttttattttaaagttaaagggatgacttttaaaagcaggacattccctacctttaatagtgcaaagcacagtttcagcaatggctacatgactatgtctaaaaactgaatactcagaatactaaaggtttggtgcttaaatttatttttcccatgccagagaaagcaagctttggtatggtaaaccacatgagaacatggctcctttctttttggatagcctggccatgtgtgaatgggattttagcttattatgtttctaagacttttccttacagcacacttaatgtaccttttcagtccttctcccaaccccctgcaaattgtctttaaaacaacaacacataaggaatctgaagcacaggagaacacagagccaacaaacagaatgaagaacaatcatctatttttaactgactttctatcattaccatttttccttttgcttaataactatcttgctttgaaactttgactccttttataagttctatgaggcacatatgtatagcaatttggttctaaaaaccagtgatcttactttagctccatcttaaaatttcaccttaagtaaatggcctctagtagatgataagcctaaaaaaagcacaattattaaaacaaacagatccatgttaggacatttctgaataataaagagaaaaggtgtttcgttgggtattgcagaaaagaggaccaatttcatatagtacaagtttcgtaagtcaggccaagtgtcaatttcaaaagacaagaaatgaaattgacagtgaatagtgctcataaattggtagcgtatataaagagaagttcctgtcacattatattcccactagaattattatccacagtaaataaatattattttgttatgccaaaaatatagcgagcagcttcatggttaataatacatttatgttgacacctccctaatccaggaaacattcacaaacaaggactcccatatacaaatactttaggaagagagatttcccaggcagatatcaccaaaaatgttttcactgtaggaatcacaaaataagtttttgtcaaaataactgttgttgaacgttatactggtcttcctcactggtgattgataagctcctttctagccagtttgtggtacttccttcattttccctagaaatgttacttgttaaatgtgtcctcaggcggtttcatctttgttgattctgcccatctaagtcataagcttctcaaatgcaagctactagctagttacacttgtaagttttccataatgacatgattttaaacataaagagttcataagaatcacttggagagactatttaaaaatgagattcctaggcccacctcagattgtgataaatctgtgtgactgactgatgcacactttttctggactataataactgatgctgctctactgctttaatacaggccaaagtaacgtggaagcgcacagcagaaaatcttcagaaagacatcaggtttgttctgattttgacaagggtaacttcttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcactaaatagatgttgaaaatacacgaatttagatacaagctttaaaaccagtttatttataaataaaacttttttgtttctgactcacattctatcagtgtttaattgatagcctgattccattgacttagcttaaaactaaaatctcaatgtcaaaaaaacactgacttggctatctagcaaagtgaatcagggaaaatctagctaatgattttatatactataacagaacctggtgttatacaggaaaaaaagccacaaacttgtaatgaagcttgtaattaaacgaggaccataactgtccaaaagagatttctttgaaactcaagaagtgacaaaaaaattaagttctctctcttgatttaagcaataaattccaaaaacatagtaaaaaacaagtttccccccaaaaaagacaaatttaatcaacagtgtaaaactatgtactgaaaatacacacaatacaattttgcaaatgaatacaagacagctaccaactttcagctctaacagtggcttgactgacagaagccaaaaataaaacactctaccacacaatatacccaaattatagacagaattattctatcagtatgtaagtgtagagaacccaaatattatcaaaatcaagagtttgctaactgaagatcaaagaggagtcacatcatgtaattaaaaattgaaacaacatattaaagatagtactaaagaccatgccagctaataggcaaaagcaaacacgccgtaagaagtcaaatgctcttgatgatggaattttagactatatacctaagacagctatttatagttttcactatcttgttatatattctctctcattcgcaagaaaattagtttttttctacttgtagaaataaaaagtgaagataggcctccatatattctagacatgcatgacatacctttcagagtcggcttcagcagtctgacacctcctgttcgtcctagctgaaactgtcacttttctctgtccttgaagatagtataattcattatcaggatttattatcagttgctttttgtttttaatctagtttctaggctaactaaatcctttgtcttcaacacaacaatcctttcaacacatgtatctcctacttgttctagccatcttggtaccagttatcactgccacagaaaaaggaacccaagcaagattaaaacttaatttattttgtaagcactaataatgagtaagggaaaataaggaaatttcaagcaagttaaaagaaggcaaattttagttcaatgtatttgaggacagtatatgaaaaatgtgttataatgaagtacctctattattgctatagcacaaagtctgtggagactcatgaaaattaagggttagaaaggtaggttaggtgcataaacaggtgctaaagaaacaacttttttttttctt

SEQ ID NO: 11149 - DNA, 1013 bp, Homo sapiens
  ENST00000510451
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaaggattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaagcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagt

SEQ ID NO: 11150 - DNA, 486 bp, Homo sapiens
  ENST00000510121
gattgtataccatctcttgattcttcacagtcaacaccaacagaggagctatcatctcagggccagtccaacactgataagattgaatgccaagcagaaaattacctaaatgcactctttcgaaagaaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaa

SEQ ID NO: 11151 - DNA, 4984 bp, Homo sapiens
  ENST00000382224
tccccacctcccatccccattcaactgcaattccctctttttggttggatctgaatcgttttgcctcaaacttctgggcttggggctctcaccctgtggattgtttagggtgacaggaatggtgggactcccgaccttgctgcagtcgcttttttttttttctttttttgcctaagacgaatgcatagagctgttatccagcaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagtaaaagaaaaaaagaaaagaaaagaaaaaaactga

SEQ ID NO: 11152 - DNA, 500 bp, Homo sapiens
  ENST00000512376
gcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagctgattcaagcatctgggtctccaagaggtctcctaccaatggttgggtgagtgttcttggatatt

SEQ ID NO: 11153 - DNA, 5009 bp, Homo sapiens
  ENST00000382226
aacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagt

SEQ ID NO: 11154 - DNA, 1895 bp, Homo sapiens
  ENST00000403006
ggcacttccggtctcgtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaataggaaatccctcatggcattatcattccctaaggacaatgagatgtccctccgctcaaatcctaaagccccctgatgaaagatttggctctgatttgctgccaacttattggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccacca

SEQ ID NO: 11155 - DNA, 2045 bp, Homo sapiens
  ENST00000381090
acctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaataggaaatccctcatggcattatcattccctaaggacaatgagatgtccctccgctcaaatcctaaagccccctgatgaaagatttggctctgatttgctgccaacttattggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattat

SEQ ID NO: 11156 - DNA, 2116 bp, Homo sapiens
  ENST00000470099
tattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattgggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataattttt

SEQ ID NO: 11157 - DNA, 2907 bp, Homo sapiens
  ENST00000237822
acctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttc

SEQ ID NO: 11158 - DNA, 1179 bp, Homo sapiens
  ENST00000626491
acttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctgattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatg

SEQ ID NO: 11159 - DNA, 548 bp, Homo sapiens
  ENST00000432947
acttccggtctcgtgccgccttcccaggaccctcagggagagcgggcagccttccaggtggacagattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttat

SEQ ID NO: 11160 - DNA, 566 bp, Homo sapiens
  ENST00000412261
gtgacgtcacctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctgattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtcct

SEQ ID NO: 11161 - DNA, 493 bp, Homo sapiens
  ENST00000402479
gtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtgagcgtaaaagtctgggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaata

SEQ ID NO: 11162 - DNA, 826 bp, Homo sapiens
  ENST00000419825
gaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagagggtggcattcttgctgtcctctcgtggtggacacaggaggcaagccctcttgggactctcgcgggctctaccctcatgaccccatctgatcctaattacttcccaaagacccctctccacctcttaatagcatttgggcatagggtttcacctatggatttgggggccatataagcattcagaccattacagctggttttcacaattgaataaaatttggatttagggcatggaggtgggtgcagaggtacaacagacagaaagagtagcacagaagggagcaagatttaatagcgatgttactgctaagcagggccagtttgagagggactttgagagctggagagagagccaggactccatgctggaaggtttctaaatggaagaagtaataccatggagatgcaaactacctcctttaaatctgtgagaattctagcatgttcactgttc

SEQ ID NO: 11163 - DNA, 3663 bp, Homo sapiens
  ENST00000619656
gcggtactgtgacgtcacctgaggggggcacttccggtctcgtgccgccttcccaggaccctcagggagagcgggcagccttccaggtggacagattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 11164 - DNA, 3807 bp, Homo sapiens
  ENST00000541941
gcggtactgtgacgtcacctgaggggggcacttccggtctcgtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 11165 - DNA, 3728 bp, Homo sapiens
  ENST00000440866
gcggtactgtgacgtcacctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 11166 - DNA, 3837 bp, Homo sapiens
  ENST00000435420
gcggtactgtgacgtcacctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtgagcgtaaaagtctggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 11167 - DNA, 2295 bp, Homo sapiens
  ENST00000515064
gggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 11168 - DNA, 2476 bp, Homo sapiens
  ENST00000441778
gtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 11169 - DNA, 2548 bp, Homo sapiens
  ENST00000304523
ccctccctcccttcttccctcccttcctccataccaacctccctccctctctggagctcctgctctctccctctccctcctctcccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 11170 - DNA, 2718 bp, Homo sapiens
  ENST00000509803
aaggtgccatgttacattttacaaggttacaaattgcagtcttcaaataatgaaaatagtctccaggtggtcctccactttctgagctaggctttatacctaatacctctgaagatcagggggaaaaagccaaaagagggaaataaagagtctctttattaaaaaagtatcaagttatgcccacttctggtgaaattttgaatagagaaaatggcctgatttagataaatcaactgaaaaagtgtacacaggagcccatttctttatccaatcctggagttaaaggcagtaacattcgttagtttcctctagcaaataagaaaaagtgcatctcagaggattctgaaacggtgatatagctacttaaaggcactgtagctgcaagaatcccaatcagttcaacagatgttttctgagctcctactatgtgcccacactgtgccaggtactagcaataccaaggtgaaaaacaacaacaacaaagccctgtcattgaagagctcactgtctaatctagggatggcaaggacattttctctctcctgccagccctcagagtatggtattgaggaggattctaaggtctagtctgggtttggtgggccatccattagtgatgtctgacatggttgtagaagttgagagtagcagcttacatgtcatatgttttgacacatatggtctagtcagaatcatttcaatttcatttgaaagaggatatagcttctgtactctgttatgctcctgtcttccaaatcaacaactgtattttactggaggttacctgtatccagagggtttgtaacaagtagagaccctttgcattttgtgtgattaagagcaaggcaccgttaggaaatgagagttggattccatcactatctccacactatgcagttaaagatgttttaataaagtaaaattgtcagatgttacagagaggcagaaagaacaaccagattaggaaaatgtacaaattcatatgtgtcctggagttgaatggacattaaatgataagcgttggatgacttgtggtgaccatatcttttaaccctgtctactgagttatcaacactattctactggttaactagagatgctacctgcaggcatccactgtctggtccaaaggcatgtgccactatgaccacagctgtggtctgtgtagctgctgcggcagcgatgtgtgtgtctggcgagggctagggtttaatccttggattctgcttctcactccatgagcaggggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgacc

SEQ ID NO: 11171 - DNA, 2626 bp, Homo sapiens
  ENST00000502640
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatga

SEQ ID NO: 11172 - DNA, 1485 bp, Homo sapiens
  ENST00000507464
ctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaa

SEQ ID NO: 11173 - DNA, 1498 bp, Homo sapiens
  ENST00000508918
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacattgtgcattcagcggcagatgccagaggaaactgcaaccagctcggggattcggaaccagatgcctgtgatggattattacaatttcctatcatgtaattgcttttctgtttgaccaaagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattaga

SEQ ID NO: 11174 - DNA, 923 bp, Homo sapiens
  ENST00000512345
tgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacagaaccaagaatttaagaccaattggggaaaaaatgaatattaatggaaaatgctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccg

SEQ ID NO: 11175 - DNA, 573 bp, Homo sapiens
  ENST00000503153
agatttgtttcctaaatcgtggtgcacccagcaaagcaacaaagctgtctggctcccattcttgtccactggaatgagcccaagtccctcgagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagt

SEQ ID NO: 11176 - DNA, 574 bp, Homo sapiens
  ENST00000504886
gcagttttcttctcatattccttgcctcctgttattttgcatgtactaaaatataaatgtatttattgaggatagagcacctgcctggatctggtgcatgcataaataccattgaatttcatctgcactgtaattctacaagtttggatttatcattggtattcagagacaggtatcttggacataatggactctatggagtgaatggatgagtgatcccagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggct

SEQ ID NO: 11177 - DNA, 567 bp, Homo sapiens
  ENST00000506732
gagggctccgacagcagttcccagccagcgtgttcagcctgcctgcctgcctgcctctgaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtcca

SEQ ID NO: 11178 - DNA, 583 bp, Homo sapiens
  ENST00000503829
acagttctctgtgttctgtctccttgcagtttctggagaatcctttgtctatagtccagatctcctttcatggctatctaatggatctgtcttctgcagcgtttccatccaggtgttggcatcctttcacagtaagcagtaggagaggcttgctgccgaggctcatatatgtcacaaacaagactacctgatcttcattgagagtcactctgatgaggacattacatgttaccatatctaatcagtagccacttgagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctg

SEQ ID NO: 11179 - DNA, 515 bp, Homo sapiens
  ENST00000508804
atacgcgaagtaatgagcaaggagcagctgagtttttctttctcttcccttttctcttcctctttgagatatttcccactttcccttgttaaataaatgatctgtctctttgcaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatg

SEQ ID NO: 11180 - DNA, 530 bp, Homo sapiens
  ENST00000513457
actagaaagacaatgtcttttgcataacaatttaatccatccattcatttactggtgaatattcatattctggaggtagaaatttcaggatttacacattggtggaaataggaaatgtagatgagccccaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcat

SEQ ID NO: 11181 - DNA, 562 bp, Homo sapiens
  ENST00000510825
ctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacagaaccaagaatttaagaccaattggggaaaaaatgaatattaatggaaaatggttcttatgcatcacagcccacctcattccctagttccctctggaggattaattgtcccttctgtctgtgccagtgacatgt

SEQ ID NO: 11182 - DNA, 499 bp, Homo sapiens
  ENST00000504189
caagagactgcagtctcgcacagaggatctctacatggcctcagaaaaccaatttgtttcttttctcatttgatatttctgctacttctgtctctctatatctacctgggagcccacagccgtgaattacggtatgaatcatgataatatgttacatttcctggagcactttgcattttaggtgccacatcattgggaactatgatgatgatgacgacgatgacgacgatacacttattctggattctatcagcaaattaaataatgatagtgacaacctctggtgggacgcctttgccactgaattttttgaagatgacgccacattaaccctttcattttgtttggaagatggaccaaagcgatacagaaccaagaatttaagaccaattggggaaaaaatgaatattaatggaaaatggtgttgctgccagaatttattgtttggggactggagaagagaactgttctacacaataaaaaattattgagaaacaca

SEQ ID NO: 11183 - DNA, 2314 bp, Homo sapiens
  ENST00000623056
agctattcttaggagcctctcaagagctccacgcagcccggctgggcagcaagggacagaacaggcaaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacg

SEQ ID NO: 11184 - DNA, 1598 bp, Homo sapiens
  ENST00000372066
gcaggcggagtgcctgagtgccctctcactcaaccctctctaccctttgtctgcagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaag

SEQ ID NO: 11185 - DNA, 5297 bp, Homo sapiens
  ENST00000361373
gcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 11186 - DNA, 1664 bp, Homo sapiens
  ENST00000623007
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaa

SEQ ID NO: 11187 - DNA, 1868 bp, Homo sapiens
  ENST00000372056
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaa

SEQ ID NO: 11188 - DNA, 3873 bp, Homo sapiens
  ENST00000263066
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 11189 - DNA, 433 bp, Homo sapiens
  ENST00000477489
gtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtatgtctctagcttggggctctggctttctgagaagaggcaggagggaggaagtgggagccagatgaccaacctctacataccttgccacgctagctttctgacatcctgatcatttttaaaagctggcaaacaccatgatgcctcgatacatcacagtcgaacaaagtttcattcctaataattatttataaaccaa

SEQ ID NO: 11190 - DNA, 5436 bp, Homo sapiens
  ENST00000429277
acagtccatttatgggcgcagccgaaggcagatatcagtgtcgatggcattcgctcccagctattcttaggagcctctcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 11191 - DNA, 1889 bp, Homo sapiens
  ENST00000542786
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtg

SEQ ID NO: 11192 - DNA, 1444 bp, Homo sapiens
  ENST00000448904
ccgtgcaccgtgtgtgcgcgcggcgttgaaatgccctgcacgtcggggcagcgggacagatcccagggtgcccagggagtctccaagtgcctcactcctcccgccgcaaacatgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgataggaccacaaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaa

SEQ ID NO: 11193 - DNA, 1410 bp, Homo sapiens
  ENST00000377962
gccctgcacgtcggggcagcgggacagatcccagggtgcccagggagtctccaagtgcctcactcctcccgccgcaaacatgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgataggaccacaaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgcc

SEQ ID NO: 11194 - DNA, 731 bp, Homo sapiens
  ENST00000431550
ccgactgcaaaggaccctcgggagggagcgcggcgaaaggggcacccgtaggagcccgggcgagctgtttcccgcccgactccccactccctgggggctaccgcgtggggcccgggtgcgctgggggccgcaggtgctggcggcacaaacgcgacggtccctctcccgccccggcccgcaggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaag

SEQ ID NO: 11195 - DNA, 574 bp, Homo sapiens
  ENST00000522943
taaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagagaaattaccacagacaccccaatcttcaacaactactaccctgatcagtcagcggccgtcaacatcaagacgagatcctccaccagcaagaagatgatgactcactgaaggttcagatgatggttagcatttttttttcagtcaagcatttttaaat

SEQ ID NO: 11196 - DNA, 812 bp, Homo sapiens
  ENST00000471827
ggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagagctttaaaaaatgtaacccatcatcagatgaaacatgaggacagctactcatctttgggagtcttagagtgtcactattattggccacaagaatcttcaatgaaggatcatccactggtgtatcttcaattttgattgatgataatgattttgagttgataaaaacaactcacatccctttagaagataaacaggccagcaaaaatacttgctagaagagtgccatgactcagtttataagagagaggctgctattcctctatcctcctccataggaaaatttccattagccagctttaccaactaccataatttaatgcctatcatatatcaggtactattctgactctgggtttataatggtaaacaaaatagaatctctgccttcaatgagtttatgtttggtataaggagaagagaa

SEQ ID NO: 11197 - DNA, 1077 bp, Homo sapiens
  ENST00000274507
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacaaatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccgaagatctaagataaataaacaagagaactt

SEQ ID NO: 11198 - DNA, 762 bp, Homo sapiens
  ENST00000512872
ctgaatcaggaaataaaattctggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctca

SEQ ID NO: 11199 - DNA, 789 bp, Homo sapiens
  ENST00000514447
aaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtaagagaggtggagtctacacctggggtgcctcctggagatgttgatgctcatttatttaatgcaggttccatacgtagagattttgtacttctttcaaaatgataaaacctggaacagaaagaatatagagtgtacccaaactagctgatgcattttttaaaaaacttttattttaggttcaggggtacatgtgcacatttgttatataggtaaaccacatgtcacagacatttggtgtacagattattttgtcacccaggtaataagcatagtacccgatagatatttttttctgatcctctcccagctgaggcactttcaaggacgtttcaccattttctctgaaaa

SEQ ID NO: 11200 - DNA, 1924 bp, Homo sapiens
  ENST00000614111
aggctctccaccaaggagggactgggccagagtcctcgcgagggcacgcggcgtggtccccagagctaggccggagcgcgggccgctgacgccactgtcgggtgaggctcggtgcatccatggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccatggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccgcctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaagaaaa

SEQ ID NO: 11201 - DNA, 1916 bp, Homo sapiens
  ENST00000611161
aggctctccaccaaggagggactgggccagagtcctcgcgagggcacgcggcgtggtccccagagctaggccggagcgcgggccgctgacgccactgtcgggtgaggctcggtgcatccaaggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccgtggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccccctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaa

SEQ ID NO: 11202 - DNA, 1919 bp, Homo sapiens
  ENST00000622419
aggctctccaccaaggagggactgggccagagtcctcgcgagggcacgcggcgtggtccccagagctaggccggagcgcgggccgctgacgccactgtcgggtgaggctcggtgcatccatggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccatggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccgcctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaa

SEQ ID NO: 11203 - DNA, 1921 bp, Homo sapiens
  ENST00000622643
aggctctccaccaaggagggactgggccagagtcctcgcgagggcacgcggcgtggtccccagagctaggccggagcgcgggccgctgacgccactgtcgggtgaggctcggtgcatccaaggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccgtggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccccctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaagaaaa

SEQ ID NO: 11204 - DNA, 2268 bp, Homo sapiens
  ENST00000402506
agactaagctgcaacactggcagagcctcccaaggaagggaggagggaggacagaggccaaggcggctcctggccaccctcgcagcttcctccctccctggccacaaggacccaaagctcagagggatggatgaacagacaggaaggctcaggctggacacgtattgtatgagtgccaagcagatctgggcatggagcaaatgctcaggaaggctgtgggatgagcacatgaaatggatggaaggatggacggacagatggacagatggatggatggatggatggatggatgagtggagcccaacaccagctctcaggtcctacggaggtggcctctctcagcagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 11205 - DNA, 2058 bp, Homo sapiens
  ENST00000402045
ggagggttttgctctttgtgtgggtgtgtgagtggctatgatcctagttgtccagctgctgcgtggagaataagtaaagcaggtctgaatgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaa

SEQ ID NO: 11206 - DNA, 2377 bp, Homo sapiens
  ENST00000222725
cgcgcggccgccaccccaccatgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaa

SEQ ID NO: 11207 - DNA, 1377 bp, Homo sapiens
  ENST00000359574
atgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggtggggaaactgaggcacggagcagctgatgcccaaggtccagcagccatgctggtgggctggggaggcgctcagactccaagccaggcaggccgtgggtccggccgccccacagctggtaatgctgcacctccctctcctgtgatgtggccccaggccccgaccccgctcaggggtggtgggaagagtcctggagagcaggagcagtgccggagcccccactgcagctggtcccagcccctgcagagatccagacgcttgttttttaaatacagcagctctgcggtgcttttccttcctcaaa

SEQ ID NO: 11208 - DNA, 804 bp, Homo sapiens
  ENST00000493850
attcctccccgtgtgccggcaggcccaggcgggcgccggcgactcctggccccgccctggcggccccctcctcttccgcagagcgctcctggcagggggcggccgcgtgctggcacagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtgagtgtggccccgggggacccccatctccctgcccgagcctggcagcgcccgccccggcatgccctcccccgatggccctgccttgtcctcaggtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcgg

SEQ ID NO: 11209 - DNA, 1968 bp, Homo sapiens
  ENST00000338732
atgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 11210 - DNA, 1969 bp, Homo sapiens
  ENST00000614382
ggtggggatgaagggctgcctgctgaaggccgattttctccttcagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 11211 - DNA, 319 bp, Homo sapiens
  ENST00000553493
aaaccaaatactcagctgcgttaggaattccttctgattcttgctgcaggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggccta

SEQ ID NO: 11212 - DNA, 1146 bp, Homo sapiens
  ENST00000254301
aggtcgcgcccctcagtgcccgcgctctccccgtcgggagcttcctggtcgcccctgcggcggcggctcggggtgtctggccggcgcggggctcgcccagcctggtccggggagaggactggctgggcaggggcgccgccccgcctcgggagaggcgggccgggcggggctgggagtatttgaggctcggagccaccgccccgccggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatatta

SEQ ID NO: 11213 - DNA, 630 bp, Homo sapiens
  ENST00000553755
gcagcacctcctcgccagcagccgtccggagccagccaacgagcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaagtaagt

SEQ ID NO: 11214 - DNA, 916 bp, Homo sapiens
  ENST00000554715
cacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaagtctcgctctgtcgccaggctggagtacagtggcacgatcttggctcactacaacctccgcctcctgggttcaagcgatgctcctgcctcagcctcccaagtagctgggattataggcgtgcgctaccatgcccagctaacttttgtattttctgtagagacggggtttcaccatgttggccaggatggtcttgatctcttgacctcgtgatccgcccacctcagcttcccaaagtgctgggaggattacaggcatgagccaccatgcctggc

SEQ ID NO: 11215 - DNA, 1734 bp, Homo sapiens
  ENST00000556438
tggcaatctagctggatagcatccctgccccttgaagagatgtttttgtggcgccacactactgacttaggcataatgcctagagatggattagaactgcacaatgaactagtggtgaggttcagtttaatggaaattggtgaaagcttttaggataaaatgataatctttgtttctttcaggaaaatggcagacaatttttcggtaagtgttttatgcctgtttcttccccttgatcagctccacatggttgagggttgggggttttgtttttaccatgactttcccttttcactctcccactgcgtggcttcccctggactcatttgtccaatgagggcttgcaagctggagccttgtttttccagcagcagatttgggaagaaagccaggcagagcgaggcctgggactcactcacagtaaccctttcaccaaaaggcccagggcggaagggagtggactctgccggcaggagctgagaaatcctctgagtagcgggaagtgcggtacagtctgggcattctgatgtttgtgattgtttttctcacggtgatgaaaaagtatgtgctataagtagaggagcgctaactcctgacttgagctaattatgaaaatgcagccctccctgatctgagacgttgggaggcaagaataaagtgaaaaagtatatgtaatcccaacatctaattttagtcttagaaactcaaactattaataagtggaaaaagtttaatgatatgcatgtaatgcctttgccatattcctctccttcttagatcacatattcctattttcctgaaaattctgcttttgagaatgctttctgtcccgtaattgtgtatgtctttctttccagctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaatta

SEQ ID NO: 11216 - DNA, 599 bp, Homo sapiens
  ENST00000556322
ggaaaatggcagacaatttttcggcccagggcggaagggagtggactctgccggcaggagctgagaaatcctctgagtagcgggaagtgcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaa

SEQ ID NO: 11217 - DNA, 491 bp, Homo sapiens
  ENST00000556263
gctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacaggtaaggagagcaaaattaacaagtctactctatttgtagattggtttttgaataaagaatggcctactttttttctt

SEQ ID NO: 11218 - DNA, 6428 bp, Homo sapiens
  ENST00000382114
gagtgggggtggcggccagcatgctgctcggctgcggctcggcctcccacacccgcggctccctagtcctcgccagcagcggcggcggcagagcagcgagcggcgcccgcgtctgcagcggcgccgggtccgagcgcgcggcgcggcggtgggggtcggggcccgggcggggagcggggaccgggcatggcgctgcggagaggcggctgcggagcgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagattttgttgttcatcagactttaccctaccagtcggtttcagtggatacgttcaactccaagaacgatgtgtacgtggccatcgcgcagcccagcatggagaactgcatggtgctggagtgggaccacattgaaatgaatttccggagctatgacaacattacaggtcagtccatcgtgggctgtaaggccattctcatcgatgatcaggtctttgtggtggtagcccagctcttcggtggctctcacatttacaaatacgacgagagttggaccaaatttgtcaaattccaagacatagaggtctctcgcatttccaagcccaatgacatcgagctgtttcagatcgacgacgagacgttctttgtcatcgcagacagctcaaaggctggtctgtccacagtttataaatggaacagcaaaggattctattcttaccagtcactgcacgagtggttcagggacacggatgcggagtttgttgatatcgatggaaaatcgcatctcatcctgtccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttaaaaaaaaatcttaaagcctgtaatttctgagaaaagagtacagcatttactcttatcatctagaaatgtaatatgcttcccccccgctttttgatgaggaagaagacaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagtgactcaaaggagtttttccctctttcttacggttcaaaggtgaccctggtggtggccagagcagtaatgcttgtttgatgctcttcatggctcatctgcttctcagaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagagaatgaagcattgatgttacatcagcactcttgggtacattctgggactgtaggctgaggcttctagcctcagaaaccacggattttaatgaacgaactcacccacgcatagtagtgttgttacttgaaacttctgcaaaataccaagcaaacaggagaaaagtggtttgttttcatttttaagtgcaaattacttttcttctgcacttttttttccctcttggtttctttgaacaggctacaaatgcccaggtccccccattggaggctgaaagggaaagagctttgccattcctccagtcctaaagatggcaagctattctttctgttgcatggaaccactcagataaacctgggcagaaaaatgggtacttggcaaactgtaggagatatttagacagtcccagcaactatgccagatcaaagtgatgttcccaattccagccacctgtagagatggcaaggtggcatcttttcacagtgttgctactgcagagaggtatcacattcccagctgcccctctgagggtaaatgagcgactgaccccctgcactcactattctgctcacattgccagattctgggaaaccaggaaacacaggatgctgggcttaggatggggagagctgttgagtccagatggggaattaggaggtgaaagaacgatctaaacaggtgatgggtggggtgtgagaagggggtgacccactcaactgcaatcaggttttccttttttataatgttattttatacaagactaaagcctgtagtctacagagcgcctgtgctgtggaaggagatatttgttctggccaacttactaaaggagcatagatgttcttggcacggggtggtgatatctttgcttcattaatcttactgctccatcccaagaatccctgaagttttaaacaacttctgcaagaagcattcttccagtaataatgtaaaacaaaaaaccaaccaagcaacagcaaaaatgcaaagcagagaaatatgtggaccgtccccagtggagatcagcttgaaggagggggtggatctttcttctactttccctcccatcacccactgggtggtcgtctgctcagcttatttcttctttatgaactttgtggcgaggctcctggactgatccctctgtgcggccatgtggctttaaggcctttccttaaagggggcttgtccccatactccatggggtcgggaatgggtctattatcaagactctaaaaataactcttagacatgaagagcactgtgttattggacagtggatgataaggccaccttacatttagcaaagctttatatttttccaatgcacattagtactcacctcatttgttcataaatagctctgaagtttattgcagggcaggtattattctaatttcagagagaaggaaatagacatgaaaactatatgaattgcctgccatggttatccaatagggactggcaaagcaataactttccctctgatcagcagacattgtattttctttctaagacaccctgctatactctcccagagaaagactttcatttctagcatgattttgaatttggcagcaccttgagataaagtaaaaagtgcaataaaatatgcatagccagaagaaaaatcatactgaatagacaccattcaatcaactggtccatttaacaattaacaaacatgcaattgcatgccccactctttttacattcaaggccccactcttgaaagtggtccagaaattttggatagttttctgttgtactaaggaggatatctagctggtctggttgtttctccccctgcatagctatggggaggatgttgaggttgagacacatctggttcttgtcacattgtccaccagataaacaagaagagatctgtgaaggaaaaattcaaaacctgaatgcacgagtggtgatgaattgctctcggccgtcatcagccttcaggaagcacactggaaatggcagagttgcattttttcttccccatggagtgagagtctgtgtatttttaggaaagaaatcagcatgggatgccagaggtttggcggtcaggagtgctcatgatggaaatttctctggcctggggtataatgaaggtgagatgaagatctgcaggaggggagtctatttgcatgccacctaaagaaaacctcttaagctggcttcctgattcttctgcagaggtatcagcctctccttcgcagctgcggaaggaagttctttaattaggcagcggccaaagattctgttcaacagcttcctggagtggaatacaataatctagttgtatgcaatgatgcaattagaaagtggtccggatttgggtggcaatggaaggggaatggcaaagtggggcagatggctctggaggaaacttgggaaagtaaaaacaaactgaaagaaaaggaaaaaaggatgatgatttcttttgcctcagccaggcaagcagagggtagaatgaccaggaagattaacaacatctcaattattaatgaagagagccaactgtaatgctcattcaaataagaagcatattgtaaagctactgagatcgaaaccaagttattattatccttactgtattccattgcttgtatcaaaatctactttttttctagtaggaaactatgcattccctatcagtccctttgattatcaggaatgtataagaattgtgataaaataggccaatatgctatttggtaccatttgtatgtattttaagtgcataacctaggtaaaataagaatagtttctatgtgtaaagaagcaagttttacagtatgcagactacagtggatgtattttaggctgtatacatatttagctctttttggtaaatagggtatacaaactatatgcctcttaattcaatatattcggtaagcctatgaataaaaagtggttcatgcctaa

SEQ ID NO: 11219 - DNA, 767 bp, Homo sapiens
  ENST00000512108
cgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagataaacaagaagagatctgtgaaggaaaaattcaaaacctgaatgcacgagtggtgatgaattgctctcggccgtcatcagccttcaggaagcacactggaaatggcagagttgcattttttcttccccatggagtgaga

SEQ ID NO: 11220 - DNA, 2814 bp, Homo sapiens
  ENST00000310123
gccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 11221 - DNA, 2891 bp, Homo sapiens
  ENST00000392225
gccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccggtgagccccctccccgtccttctgcctgtccagcagcctgcctggctggcctgacctgcctccccacctccccacagcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 11222 - DNA, 2200 bp, Homo sapiens
  ENST00000493050
ggatttcgggatggaaagggggagaggctgcccttctaggaaccccccagtacaagcctcctttcccagattggtgtaactaggcccagatatggacgaagagcaggctcggggtccgccagaaatgaggagcacccaggagcagcttatgtgctggcagggggcttctaagctggttaacaggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgc

SEQ ID NO: 11223 - DNA, 2630 bp, Homo sapiens
  ENST00000587780
ccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtgaggctgggcctgggggcggggggctggcttttcagcactgacccaatcttgcacactaagcctctaaactctgacctaccctcacatgccgacctttgaaccaggaccccaccccacactgatgccaagactctgaccccctcaaggctggctgactccgaaccactccccagtccccgacactgatgctggccccaacatcctgattctacccccaaatgctggctctgtgactcggatgcattccagacttcaccacagccacacctgtccccaccctgacactgagcccccaaggctgatgctagggttaagcactgcccactgtttctggagtgaggtgcaggcaggggagggttctgagtctggaagggccctgatctgactcaggtgttcacaaggtctctgggtggggaacagactgggggagcagggagaggagcctagaggccagggaagaggctgccaggatggtccagtcaggaggggatggagttcagccagaggtggtgggagaaatgtacaactgtagaaggtgaaactgacagagtccatggctgagtgcttctgtgtggggcgtgagggcaagggaagggctcagaacaactgcatgtgtgtggccgaacaggtgggtggtgacttttatgaagataagaaagctatgggagttttgggaccgacaggcttctgcttccaagctgttccacggcccccagagacccccgggaccccaggccctcactggccacacccccacaggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgt

SEQ ID NO: 11224 - DNA, 612 bp, Homo sapiens
  ENST00000591840
gggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgt

SEQ ID NO: 11225 - DNA, 1076 bp, Homo sapiens
  ENST00000593248
ccgacaaccagctcaagggagtgtgcgtttatgcacatgtgtgggagtgtatgctcacacagatgtcaggtgggcattgatgcacgtgtgtgggggtgtatgcacacgtctgtacaaaagcatttgtgtccatgcacatactcacacctgcgtgcccatgcccacctaggctgagggtggaggccagggttaaaatgtcagatgggggctgcaattctggaaaaatttctttcttgcccccttgccagcctcttcacctccaactccttctccgtgattgaggacgatgcatttgcgggcctgtcccacctgcagtacctatctacaaagggcccggataaccagagcctgattctggctctccctgactcatagaaacccaggaagggtgtacagaagtcagagacaagaaacgtttcaaatgaccaggaaacaactctgaattagcttcatcgaggacaatgagattggctccatctctaagaatgccctcagaggacttcgctcgcttacacacctaagcctggccaataaccatctggagaccctccccagattcctgttccgaggcctggacacccttactcatggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccggtgagccccctccccgtccttctgcctgtccagcagcctgcctggctggcctgacctgcctccccacctccccacagcggcctccgtggtgtcctgcaagccactggtgctgggcccgagcctcttcgtgctggctgcccgcctgtgggggg

SEQ ID NO: 11226 - DNA, 1113 bp, Homo sapiens
  ENST00000591633
accaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggacaggaggtccttataaacgttcacccttgttaacataaaagcaaccaatttaaaaa

SEQ ID NO: 11227 - DNA, 1102 bp, Homo sapiens
  ENST00000473160
ggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctgtgagtggggcctggctgggccgacaaccagctcaagggagtgtgcgtttatgcacatgtgtgggagtgtatgctcacacagatgtcaggtgggcattgatgcacgtgtgtgggggtgtatgcacacgtctgtacaaaagcatttgtgtccatgcacatactcacacctgcgtgcccatgcccacctaggctgagggtggaggccagggttaaaatgtcagatgggggctgcaattctggaaaaatttctttcttgcccccttgccagcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggaca

SEQ ID NO: 11228 - DNA, 557 bp, Homo sapiens
  ENST00000592346
tggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctatctacaaagggcccggataaccagagcctgattctggctctccctgactcatagaaacccaggaagggtgtacagaagtcagagacaagaaacgtttcaaatgaccaggaaacaactctgaattagcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttcca

SEQ ID NO: 11229 - DNA, 4611 bp, Homo sapiens
  ENST00000266674
aaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaacaaaa

SEQ ID NO: 11230 - DNA, 4095 bp, Homo sapiens
  ENST00000550851
agaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctgtgcgtatcagtaaggcaataatgttgtgtaaacaggcaacttccatttaggggtgaaatggcagacatgatttcaataatctctttaaaagaggagaaagtttttcctttcaggtctgcaggaggtcaagcctcctttgccctctttggtccaggctctctgacatgatcctggtaacaaatggctttgcagagcagaacaaaataacataatggatcaaccacccaatatggatgccaaaatcaaaaactgagatctcagatccacacaatccttgataaagagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaac

SEQ ID NO: 11231 - DNA, 2664 bp, Homo sapiens
  ENST00000536515
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 11232 - DNA, 2800 bp, Homo sapiens
  ENST00000540815
ctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcgg

SEQ ID NO: 11233 - DNA, 298 bp, Homo sapiens
  ENST00000549015
atggatgccaaaatcaaaaactgagatctcagatccacacaatccttgataaagagatctgtcttacaacctattagaagatttacccagtttttcagtctgccaaaagcttcagaaaattgacctaagacataatgaaatctacgaaattaaagttgacactttccagcagttgcttagcctccgatcgctgtgagtatcacctcccagtgcgttccccagcacagagcattttctttctctttggggccttcccctaatgttttcttttcattgtgtactattgtggtgggacttt

SEQ ID NO: 11234 - DNA, 576 bp, Homo sapiens
  ENST00000547310
tataaatgaattcattaagtaaactatttaaatcaattaaagaagtataacagttacatttcagtaaacatttgaatctactggttaatccaataatggctgtgactacctgctccatgtcagggctatgaaaatgttcagagtctgcctttgggagatataacatcttggagggaaaaggagagcaaagcatgtttctttatgatttatttgtaacagattttccctttttgcaccttctgtttttcagagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttc

SEQ ID NO: 11235 - DNA, 3567 bp, Homo sapiens
  ENST00000367278
gcccgccgggaccgggaggaagcagctgcggccatcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctgtctgccgactgctctgagctcgggctgtccgccgttccgggggacctggaccccctgacggcttacctggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattacacatgatgtctttttcttagagattcacagtgcatgttagtgtaataaagagataagtcctacagtagtaaaatctattgaactttg

SEQ ID NO: 11236 - DNA, 3406 bp, Homo sapiens
  ENST00000255432
gaacgcttgtgtctaactgatgctcctaatgcggaagcccctgaaaggcggttgtggtgcaaaggaaaacccacaggccaaggaatgggaagaccaaggttgacacttgtttgtcaagtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattacacatgatgtctttttcttagagattcacagtgcatgttagtgtaataaagagataagtcctacagtagtaaaatctattgaactttg

SEQ ID NO: 11237 - DNA, 3377 bp, Homo sapiens
  ENST00000487787
tgaaaggcggttgtggtgcaaaggaaaacccacaggccaaggaatgggaagaccaaggttgacacttgtttgtcaagtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatgagaagtggggggctctactttcttcctcccagtgctcggggggcatggagcggagccagggtctgagcctgccggctcatccagcctctcttgctgccctagcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagaga

SEQ ID NO: 11238 - DNA, 792 bp, Homo sapiens
  ENST00000423542
tcctattcattctcttgattttttttaaagaaaacttcttttgaaaatttccatccaattccaaacaagctaggacgaacaaagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctagacctgaattataacaagctgcaggagttccctgtggccatccggaccctgggcagactgcaggaactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaat

SEQ ID NO: 11239 - DNA, 2487 bp, Homo sapiens
  ENST00000439764
atgcgcttggagggagagggccgctcagcgagggcgggacagaacctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaa

SEQ ID NO: 11240 - DNA, 557 bp, Homo sapiens
  ENST00000503519
ggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgtgagtcattagagggctggtctgggagtcaccagcttcctggggcctgagtcacagcccagggccccctgcctcagctttcccttccctctgcaggcgccccctctcccagtccacgttccagacagcatgccgctcctggctttggtttctccggggttttctgttgtcatcagtgtgtggctgtgtacactcctatgcatatttcaggaaaagagtgctcccacgccccactgggggactgtgggaatgggacctccctaggtgaggccaccaggccagcggtcctggggcgactggtgttctgccattggagcctgggtttaggggtggagactgcc

SEQ ID NO: 11241 - DNA, 866 bp, Homo sapiens
  ENST00000308543
cctggattgacccctctccatcctctcttccaccaggcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactgttcaagcgattctcctgcctcagcctcccgagttgctgggactacaggcacgcaccaccatgcccagggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagct

SEQ ID NO: 11242 - DNA, 454 bp, Homo sapiens
  ENST00000506931
accaggcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactgtgagttttgaggtcttggtcaaactctgtcctgcctggtgatgaaagcctggagtcttggagtggagggagcacacagagggaagagccagcagtcctgggatgctggggtctggccccgggcttgtttacccacatgcccctccctggcactttctctg

SEQ ID NO: 11243 - DNA, 2110 bp, Homo sapiens
  ENST00000379589
gtgcgatccccggcgcccgcgcgcgcccacagcgctccgccagagctgccgccgcggactcgccgggagtgggggtctccgctggtgccagcccgcttctggagaccctccgcctcctgccaacccctgctcttccaggtcgggccccggggttctgcggctgttagggacagaggcaaagaagggcaggacggtccggtttcccgtggatgttcccgcccgagaaagacagcaagttgtgtgtgcgcccgggacgcgggagggaaggtggccgccgcccgccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaata

SEQ ID NO: 11244 - DNA, 446 bp, Homo sapiens
  ENST00000495922
cgtggctcctcggggtcacccaggaagacaagcaactttctcccatacttctcggtctgtctgccttccccactcagctttgaatgagacgcagggagagggggcgcgagggggctcggggctaggggaggagccgcgaaagctgcccccgggggtgggcctggacccgcgcggacagcggggcacccccccactcccttcccggcgctccaggaacgtcgggccccggggttctgcggctgttagggacagaggcaaagaagggcaggacggtccggtttcccgtggatgttcccgcccgagaaagacagcaagttgtgtgtgcgcccgggacgcgggagggaaggtggccgccgcccgccagccatggaccatcatctttagtgcagaggatggaaagttgatgcccagtaagactgaagatccattctgcattacggaactgt

SEQ ID NO: 11245 - DNA, 4680 bp, Homo sapiens
  ENST00000515007
acacgtgaaggaagcctttgtgggccttcctgcgcagctgactagctgaaagccatcgtgagccagcccaggagaaaccagcagaggaacagccagccgaaccctgggattgtgagaaataatcaggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttcaa

SEQ ID NO: 11246 - DNA, 570 bp, Homo sapiens
  ENST00000502722
atagagagggccgtggggttagaaagacttccttgtgaatcacccctcttcaaacaatgagcatctgaattgattccctctactccacccctgctacaaagtcccttgaggccatctgagaagaacaatgggatggggtggagacactgaaatcccaaaatgccctggtagtgacatgccaagctggacaccatcacaggatgaagaccactgtgaaagttgtgatgtgtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaacta

SEQ ID NO: 11247 - DNA, 577 bp, Homo sapiens
  ENST00000503686
ccttcttccaggcgcggccagcgggggcaagagcgaggtggctgcgaggaggcgtcactgaaagccctgacttggggaaggctgcgggctcggagccggagacgccgagctggggccgggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccag

SEQ ID NO: 11248 - DNA, 933 bp, Homo sapiens
  ENST00000512759
ccggacgcccggcccgctcgcgggacggaggcggcgatggtgactgggcagcggcgcggggccggggcctgggcagggcggctcggccgcctctttctctcgctgcccccgcccctcctcctcctccctctccccgagtgctagcccgggcggccgccgagcttggcgctctctcgcctcgctgcctcctcccccgcgccgcggaccctctcccctcccttgcgttgcccccctctcccgccgcctcctcccgctctcctctcgctctcctcccgcctccttcttccaggcgcggccagcgggggcaagagcgaggtggctgcgaggaggcgtcactgaaagccctgacttggggaaggctgcgggctcggagccggagacgccgagctggggccgggtgagttgggaatcagactcttgagttgacagctggcctatggtttctgcattttgttaagaagcacctcatgcaagcgagggacctgggactgctcacagccaggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggca

SEQ ID NO: 11249 - DNA, 534 bp, Homo sapiens
  ENST00000510949
gtcttcctggaccaaaagggatgaaaaagagctatcatgaggaacgagctctagtagagccatgtgtgtgaaagtgtgggtgtttgtataatgatgcaagagcatttcgtagcaggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccacc

SEQ ID NO: 11250 - DNA, 2093 bp, Homo sapiens
  ENST00000515349
attatgagaaaaggaagagagaccagagctcactctccagtgtgtgaggatgcagcaaaaaggcgactgtctgtctgcaagccaggaagagggccctcatcaggaaccaaatctcctggcaccttaatcttggacttcccagccttcagaactgtgagttgggaatcagactcttgagttgacagctggcctatggtttctgcattttgttaagaagcacctcatgcaagcgagggacctgggactgctcacagccaggagctggtattttcccctgccagttgatgatggagactgcggacacctccctttcagttggatgcggtgccctcagaaactcccagaaggcaagactccagccaggggttctcctgaaatgtctgaagggaattgctgggggtggggcgtggagagggaagaatgtgcacttgatcgcttaaggcttctccgtatcctgtacgtgaatctttgcccttctctacgcggatgcaagagtcctcttgctttggccacgtgctgctcctttccttcaggactgtggctaatcagaagttggctgcacttcagtgcctcttaaaagcttttttccctggctgtgttcaggatgttgaagtgcagtgtcagaaatgatgtgagttgatgaagaagaaataaacaaacccaggcagcatgtgaggaaggcttggcagccctgctcctgtttttctttagtttggatctgaaggaaccagatttcctcattggaaggaatggggctatgagggtccctgtgccatggagcctgagatgtgcatgccagtgggccttctggactagggcaccggttagtttaataactctgggatgaaaatgtgtagtttatggttggcagaatggagagaagtcacctggccgcaacccgacctatatgtctatatgtaagtggagttaaaatagcatctgttcagggaggcggaacattccagaatgcttcagtcccctcttggcgccaatgcagagagtggagaataggaaagctgggagagacttcacagagcttcttgtctaagccccttaatttcagtttaggacactgaataacttggctaaagccccgtgaggccaggggctcttgtctgtcttgtttgttcaccttcatacctttggtgcctgcattgtattaggtacttaaacatgcatttgtttggtgaatgaatgacataaatgaagatacgacttccgactcctaatccagtgctctctctgagatatttgtaggcagaaaagtctgtagaagtgttgccaaataacttgtatgtagttgaggctatcttgagattatatataggttagaaaatggagatgtagcaaaatcaaactggctccttaaagttggtggtgaagacaggcttgttcaggtttgggggtgggtaggaggcaggactgccactttgctcagcagatggggctcctttcacattggattgtgtgtgagtggtgccctctgaagttggacgatggccccaatagctcagcttccccagaagaatcaagatgactgtggaaaaaataggcttgaagttgcccctttccttaccagcagctaggagcctaccctcgttttgcagcccagtccccgccttttcagagggatgtgtgacttggagctcatcagacttaccctctgtttgtagaggggtgtgtgtgtgtgtgtgtgtgtgtgtacgtatagaatgctgcaggtgtgactggaaggtcacgtttggtcactgtagcaacaggagtaggatgaagtcctgcacacagggtctctgccactgtccaactccatttggagaattgcaactctgttgccatgggccccaaccaaggaaaccaggtcttacagtgggctgcacttagaaaaccagggtagtcctggccagcatggtgaaaccccatctctactaaaaatacaataattagctgggcgtggtggcaggcacctgtaatcccagctacttgggaggctgaggcaggagaatcgcttgaacccaggagacgaggttgcagtgagccgagattgcgccactgtactccagcctgggtgacgagcgaaactccatctcaaaaag

SEQ ID NO: 11251 - DNA, 510 bp, Homo sapiens
  ENST00000514587
ggccatctgtgccatcttcccagtgaacttgcagacaaaaccaacagcacaatgctgatatgaagaacagatgaaatttacagatgtttgcacttttccatgtgtttattggcccccatggctctttcctgagtggcctgaccagccctctcccccagtctcctgggccccatagtagagggagcagaagagggtgggaaggagccccagctgggaggagacaggaaggaaaaaccagcctttgtttgaacctgaaccctcgtcccaggctggctaccagtcctcctgttccagccttccttttccagtatgaataatcccagtttctttcatctgaactcctgaacctccttcagctcttccagtccaccagcaccctcgtgattctgggcttaacacaggtgagttgggaatcagactcttgagttgacagctggcctatggtttctgcattttgttaagaagcacctcatgcaagcgagggacctgggactgctcacagccaggtgg

SEQ ID NO: 11252 - DNA, 5043 bp, Homo sapiens
  ENST00000380345
gggcagggcggctcggccgcctctttctctcgctgcccccgcccctcctcctcctccctctccccgagtgctagcccgggcggccgccgagcttggcgctctctcgcctcgctgcctcctcccccgcgccgcggaccctctcccctcccttgcgttgcccccctctcccgccgcctcctcccgctctcctctcgctctcctcccgcctccttcttccaggcgcggccagcgggggcaagagcgaggtggctgcgaggaggcgtcactgaaagccctgacttggggaaggctgcgggctcggagccggagacgccgagctggggccgggtgagttgggaatcagactcttgagttgacagctggcctatggtttctgcattttgttaagaagcacctcatgcaagcgagggacctgggactgctcacagccaggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttc

SEQ ID NO: 11253 - DNA, 1852 bp, Homo sapiens
  ENST00000424859
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactca

SEQ ID NO: 11254 - DNA, 1378 bp, Homo sapiens
  ENST00000401970
gtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagatgatggaaatgcttaaggcaaactaaggtagtgtgagaccacaccatttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttc

SEQ ID NO: 11255 - DNA, 567 bp, Homo sapiens
  ENST00000634033
aacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgcggggctgtgcgcccaggcggccgcgagttgtgactggagccacgatgcacggccaggcgcgctctacctcaagccccggagaactcagcggcgctttcctcgcaacccgagctcggcgagtcgtcgtcttcttcttctccgtttttatttatttatttccgttcccgcc

SEQ ID NO: 11256 - DNA, 3428 bp, Homo sapiens
  ENST00000620305
ccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggtaagatggtctccagccagaccgctcagtaaaatgacttgaacatcagctgtacaagaaaagtattctaccttcacacacaaaaagttaaaaaaaaaaaaaaaagactattgaactaaaaacagtcaactgtttacgtataatgttaaattcaggagttcagtgttttactaatatatcctgttttgaaacctcttgttcgaaaacaaaatgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgttta

SEQ ID NO: 11257 - DNA, 1840 bp, Homo sapiens
  ENST00000631483
cttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcccacagaggcccacactgccactttgggcacccaggccgagccaggagagcccagaatccagagagaagtgagagatggagtccagaggtggggtgcctagacacatcccgagcctgcgggacctatgaaatgcctgatgccttcgagcatctagaaagtcctcttcccagcccaacagaggtgatcgtggcagtggagggggagggacgggagttcagccagaggctggaggaggagaactgttgaacactctggagagagtggggagccctctttctgcacataccccaccccacctcgggttcggaagggtcagagaagtctcagtgtcccccagagtcaatcagtccctctgccttctgcacaaagtgaactcttcctaagtctgcaactccaactttgtgatcgcttgctccaattagacaagccccagatcagggacttcccctccaaagagaggtggttccgccgggagtcagctctgcttccagcgggttggagtgaaatttgggtatgggagcctacctggaggcagctgggcctgtgggcggaaaggaggtgagactgctgaagctccaggccagggggagtctctggctcagtgctaggtgtccggt

SEQ ID NO: 11258 - DNA, 1364 bp, Homo sapiens
  ENST00000631517
agttaggaactgcttctagagagggcagccaagtcccgcgggcgcccgcctctccgccagctggcgcgctgggagcccgggacgcggccctgcttgcatcctggaaactatgggtctgggtttggctgcatgtgcctgggaagaaagggtctgagcctgactcggcccagaagccccttcaagcttggaagagacagggcagcctcgggcgttgtagcccggactgctgtctttcccggagccaagctctgcagcaactgcattctccaggccttcggggttgtttgccctccaggcagagcccaggctccctcccggccactaccttttccgaccccgagcggtcttggcggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcccacagaggcccacactgccactttgggcacccaggccgagccaggagagcccagaatccagagagaagtgagagatggagtccagaggtggggtgcctagacacatcccgagcctgcgggacctatgaaatgcctgatgccttcgagcatctagaaagtcctcttcccagcccaacagaggtgatcgtggcagtggagggggagggacgggagttcagccagaggctggaggaggagaactgttgaacactctggagagagtggggagccctctttctgcacataccccaccccacctcgggttcggaagggtcagagaagtctcagtgtcccccagagtcaatcagtccctctgccttctgcacaaagtgaactcttcctaagtctgcaactccaactttgtgatcgcttgctccaattagacaagccccagatcagggacttcccctccaaagagaggtggttccgccgggagtcagc

SEQ ID NO: 11259 - DNA, 512 bp, Homo sapiens
  ENST00000633397
gcggccgctggtggaccgcctggagccgggcgagctcatccccaatggtcccttctccttctacggagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtg

SEQ ID NO: 11260 - DNA, 569 bp, Homo sapiens
  ENST00000619297
aacagccaggagcagtgaccaagccgccggagctggggagagacgcaccggggcggcgactgggccaggagaccagggactgagggacgcgcccggggagggccagcaacgagccgcggcccgggcggcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgcggggctgtgcgcccaggcggccgcgagttgtgactggagccacgatgcacggccaggcgcgctctacctcaagccccggagaactcagcggcgctttcctcgcaacccgagctcggcgagtcgtcgtcttcttcttctccgtttttatttatttatttccgttcccgcc

SEQ ID NO: 11261 - DNA, 3425 bp, Homo sapiens
  ENST00000614239
ccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggtaagatggtctccagccagaccgctcagtaaaatgacttgaacatcagctgtacaagaaaagtattctaccttcacacacaaaaagttaaaaaaaaaaaaaaagactattgaactaaaaacagtcaactgtttacgtataatgttaaattcaggagttcagtgttttactaatatatcctgttttgaaacctcttgttcgaaaacaaaatgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgttta

SEQ ID NO: 11262 - DNA, 1840 bp, Homo sapiens; identical to SEQ ID NO: 11257
  ENST00000619939

SEQ ID NO: 11263 - DNA, 1364 bp, Homo sapiens; identical to SEQ ID NO: 11258
  ENST00000616237

SEQ ID NO: 11264 - DNA, 512 bp, Homo sapiens; identical to SEQ ID NO: 11259
  ENST00000621767

SEQ ID NO: 11265 - DNA, 2939 bp, Homo sapiens
  ENST00000261731
aaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcgagcaatttcttgggaccaaagtcaatactccggagggtcaagagatttcgagcacgctctagactttccccgggcccccacccacccacccagccaccgccacctctttggactgagagagggtgaggccaaggggcggagacggtgtttttccctctctctgcaatccgagtggcattttgtaatcttatttctcgctgtgctttccccgtctttaaaaaaaaagatgataagaaaaggagagagattgaaagagagggagaggaaagggggcaagatgaggaggagatggagagacagcgtcagccagagggagaagacggagagcgagcgaggaactcgcgtgaaccgggagccaccgagagggagaccgagccacctgcacgctggcgctccctggtggccaatcttgaggctcaaggtcagcttctctaggaatagggctgtgggtcaggaagtggccagccgggtccagctcccgctcttccttactttgacgtttatgttgagcccgagggagcaggccggactcgaacacgcacacatcctgctctccccctgggtggggcgccaggattgctgggctcagacccacagaccaccctccctgcccagggcctggaggctgggccgtcaggatgtacaatattatacttttttggaagttgaacgcttctagtttccttattttgtataaagaagaaacaaataaagtatgtttttgtgtttactgtttatttattgtactctagttatccggggttggacatttttatatttttaagaggaggtagggcagagtgacggaggggaagcagaaagaggtttacctaaaaaaaacaaaaaacaaaaacaaaaaaaatcaactttttttaaagagaaagattaataaaaaaaaatcttttttccctc

SEQ ID NO: 11266 - DNA, 713 bp, Homo sapiens
  ENST00000557836
ggggagcgaagtgtggggcgtggggcaacttctgcaagttccagggatggcgaagggggcaggggtacctcccggactaggccttggaacccgtgacccccaaatatttgtgaggagaaagagagaggaagagagacgcaattttcgtttcgcgctgcccccgccccgtcagccccaaactggaagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcg

SEQ ID NO: 11267 - DNA, 676 bp, Homo sapiens
  ENST00000465039
gatgtggacagggaacaggcagcctctccgccctccagtgccctgaggagcagcctccagaggaagaggagttgccagtctccctggcctgccaggaaaagatataacagagtgctgaaaagtttgagtcccctgacgcctatcttcccagctgaagtcgaacaaggcaacgctccgccttcttgtttcaggccaggcgcggtggctcatgcctgtcatcccggcactttgggaggctgaggcaggcggatcacctgaggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagg

SEQ ID NO: 11268 - DNA, 2773 bp, Homo sapiens
  ENST00000440097
gcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttacttgtactgggccggacttgagccccgacccttcgccagcatctccccgctgccctcaacacacacacacacacacacacacacacacacacacacacacacacacacacacacacacacacacggcacctgggctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgaggtaagatgcccttccagacatgctcccaggggcttctaagacatgaatatctccctgggctcatttacaagatccatgtcctgtccttacagcttttaaggtatccttttaaaaatctcaactctggcctggtgcagtggctcacgcctgtaatcccaccccttttaggaggcccaggcaggaaaattgcttgaggcctggagtttaagaacagcctgggcaacatagcaagacctcatctctacaaaaaattgttaaaaattggccaagtgtggtggcatgtgcctgtagtcctagctgcttgagcccaagagtttgaggctgcagcgagctatgatggtgctactgcattccagcaggtgacagcaagaccttgtctccaaaaaaaaaaaa

SEQ ID NO: 11269 - DNA, 11331 bp, Homo sapiens
  ENST00000273317
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgatttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctctgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatatttcctgggtcttttctgtgtgtggagtcagcaaactgttttttgctacctggactttgtcttcttttacagctctggattcttaaaagtaccacataggtagcaaacctgtgaagggtatgagattttaccctacttgcaggctaataaagtgagcacaccacatgggttcatggatcctggcagaagttatgagactcataggtcagagacaaaggacagtttattatagcaatagcagtggccagattatcagcatttacactggttccctgagccccaggccccaagaagagggccaggtgagacctgcacacgcagtgggctgcattacaagaggaacccccatgcttaggggaccctggtatttgataatgggcagtaagcctgcctgacttttgctccagagacagacactatctctgtcatccaagactgttcactagataaacatccttgaaaatataagtctggaacctggcaattggtgtctattcttaccagatgtataaaaatgtgagaggccttggagaatcatatcccaagaatcagcagtttcttttactggacctttaagattgagacttgtaaggtcctgatgcagtgacttgtaaggtcactttgtctctcttgtgaatgttactgttttttctcttctgaggttatgaccaaagaatcctcaaggcgagtgatccttcaggtttgagacagccacatgcaggaagacaggacttgtagagtgttggggccaagtgtgtggttagaatccttggggtggggaaagagtttgttctagactccagtgtagtccttgtggctaccaggtctgacgtgccaaggacacgggaaagctgggagtgaggatactcatagtcatagcaccttacaccagaataaaagttttttttttctttttaagtgatgagagaatggctagtctgattttgccaacatgggctgctatttgcttaagaccttgatggtataaggagtgaagatgcaatcagggtaaaaggcggtctggagttgtggtgtgctggcaaaccagccctctggggcaaaaaattaaaaagccttgatatggagtgtttgctgatacctatgatgtaaatattcccgccatggccactttccagctaccagcaaggcatcctggcaccagggattgggaggagatggcatagtcctaagagtcagccttgggcattgggccatgtgggactgggcagtggggtatctggtctggttctaagtgctgtgatgaagcagtagcagctgtaatagctggcatttcccgtgtgctcatcacatagcagatgttattccaaggactgtatgttctttatcatccctcatttgatagacaagacaactgagacacaaaagggtgaaataaacagtaagtactccatcccaggccatctcatccagagggtgctgtcttgaccactctactactctggttgatgggaggcagtaaattgtccatcagtatacttcttcatcaaagctacatagtcaaaaagccacaggaggctgtgaggagaagctcactgctgctctgttgaagtctgtattggtttcctatggccactcttaacaaattaccacaacctcagtggcttaaaacaacacaaatatatcattctgtcatcctggacacgagccaaaggttgtcggcagaagcgaattgcttccagaggtgctatagggtgctgcccattccttgccccttttccgcttctagaggctgcccattttccttggcttgtggctgcatcattctggctgcttctattgtcacacctcctctctgaccctccctgcctccttgtaaggacacttgggattacgcccatccagataatctagaataatctcccattttgtgattcttaataacatctgcaaagcctcttttaccttgcagaataagatattcacaggttctggtgaggaggacagggacatctctgaaggggagggaagcaggagatagggtctggaggcatggaattggcttcctaaggccaattcaggctgacttcctagaactaagtcaaaaggaaaaccccaactttccacgctcaagtaacaaaaggaccagaggctactccctttgcaacctccccacccccagccccttttctgcatggcaggtgaaaaattgaaagtatcgctaattgatcccctcccacaaccaatcagactggtcttaggccaagtcttcatttgcctaggagtataactttgtaacttcagcctctgattgggcgttttacacaaccagtcagatgtttgtatagggtggtgtaactttgtaactttgcttcagcctctgattggtcccctcccacaaccaatcaaactgatcatggacctctgcttcatttacatagggtgtacaccaagtaaccaatgggaaacctctagagggtatttaaatcccagaaaattctgtaaccgggttcttgagctgcttgggctgctcccaccctgtggagcgtactttcgtttttcaataaatctcttttgttgcttcattctttacttgctttgtgcgttttgtccatttctttatcaagacgccaagaacctggacaccctccaccggtaacaggaggagcattagtcagcctaccacagactccaacgaacgttttttgagaggaaatgaaagaatattcctaagttattgggtgccttttcttcaggaatccctgaaagtgggggtttgcaattttccctggattgaaaacagaaatgcttcctacacaaacatgattgagaccttgtactctaggtgtaaaaaaacagagtaggtcatactctgtgggttatggtcagagagatctggttagaagttcccaggtaggcgacagccctagatgtgtgacacttctaggagaatctctggctatgtggatacgtccaggtgtgtaaggcagcctcagggactgccaccacttggtcacatacatgtccctccaactaatcctagctctcaaggacaggtggttctgggccctgtgttgcccatgagacttggtccacggcaagcctgtgacggagtgaaagtgaggggacacccaatttgaaaactcggcaggaagccagactccatgacatacaaatagatcaaagtgaatcggctccgttgtttggggaaatacctgaggtttgttgtttcgtgccaagaagattaacaacacggacacacgtgggtgggttaaggagcagaaagtttaacaggcagaaaaaagagaacagctcccccatgcagagggaggaggactccgaatggatctccccattcctggcgggaagcagactgatatatagaggagggggtttgaagaggtggtatttgatttacatagagcccaagggattggtttgaccaggtgtgccatttacatagccctcgaagaaactggccattccaccttgatcttttattatgcagatagggttttttacttggccagagccttgacacctgcacacatggcaacaaacagaagggaggcgaaatcttccatattggatgcacctgtcttccaggtgcagctgccggcatttatctgtgcaagcttctagcttgcttatttatgcttgcagcttgacttttcaggctgctttctgttggaaaagaaatggttttgggggctgctttttattaaaagaaaagccttaccaaggactcctgtaccctatctgcctaaattttttttaactactatattaaaaggtctgtaagtgggagctggccctaaaagtaggttgtagagattatttggatgtgccaacaagcttcatctgcagcttggactgtctccattggaaggcctctggcagattttgtaaaaagttatataacaattttactataggaaaaacttggctacagatatgaatttatattacccatcattggctggttccttatcctgaacattggtttccttggaatctgattttggcttgtttggcctttaaaaaccccagaagaatggggtttctgccagattattttctggttttcagtctcactgaatgtcacaaaggccttggtttatggttcccaactggtaaagaaacgtcaaactttgcctctcttagttccttctacatgacaatgggtggcagttgctcatatggaagcatttcttttccccctaaagcctatgagacaggctgcaacttaaacccctattttattaaaggagaggaaatgtccaagagcccagagatagtgggtaaaagcatcataaggactagaaatggggtcttcttgttgctaattagtaggggtgaggggtaagtggcagatgtgactgccgtccatgcccagacagggaattgtccttgaacctactcatgcggtgtcttctggggtacagtgagtccacagggcaggacggccttggagtcaagagcccagactcacattctatctcaggcttcataactcaattgctccatgaccttaagccaatttagttccctcatctgtaaaaatggggataacaactgaatttacctcatgggattgtgtaatgcccaaccttgtttttactaaccctgtttttagactctccctcttcctttaatcacctagccttgtttccacctgaattgactctcccttagctaagacagccagacagactccatcttggctctttcactggcaccccttcctcaaggacttaacttgtgcaagctgactcccagcacatccaagaatgcaattaactgataagatactgtggcaagctatatccgcaattcccaggaattcgtctgattgataacgcccaaagccccgggtctatcaccttgtaatagtcttaaagcccctgcacctggaactgtttactttcctgtaaccatttatccttttaactttttgcctactttatttctgtaaaattgttttaactagacccccccctcccctttctaaaccaaagtataaaagaaaatctagccctttcctcagggctgagaaaattttgagtgttagccgtctctcggtcgctggctaataaaggactcttaattcgtctt

SEQ ID NO: 11270 - DNA, 513 bp, Homo sapiens
  ENST00000474665
ttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggtagacccctccccacccagcccccaaagcccattgtagacatccaagagaaaagcatcctgcgttgactggggcaagaggcagtcaacaagattctggcaagggtcagccctctagagcttctgtaggaaatggaatgaaggctggttcttggg

SEQ ID NO: 11271 - DNA, 1409 bp, Homo sapiens
  ENST00000426981
tgggcgtccccatctgcggggcctgccgccggcccatcgagggccgagtggtcaacgcgctgggcaagcagtggcacgtggaggtgagccaggctggtggacacgtggcctcaggttggggggtgccccagctcagggtcatgcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaaccacagcagcctgcgtggtttgtggcgggggtcgggggtggaggg

SEQ ID NO: 11272 - DNA, 4807 bp, Homo sapiens
  ENST00000469300
gatggggttatttctgtccattgtgctggtgtggccactgcacatctcccctcaagtccacatcgatgtcatgttggcagccaggagttggccatgacgggaatattcacaccatggacactggcaaacgccccacagcagggcctgcctctgcgccccagagagctggctgttgagcatttaccagaacatcacttgtgcttgtggtggcggtggtggccaggggtcagatgctggctctgtttcaaggtagagctgatgggactggctggtggatggatgtggggcctgtggtccgcctggcagagcaagagccgctgttcctcacagtgtcttcagcctcctgaggaatgctgtctaagtgtagaggcagcgggaggggtgggcaaagctctaggaggggtggccatatgcccagaacaaagcctctctctctcacacacagcaggtgcccagaagattttcattgctgaaagagtttaagcccttcctgactctacaggtcactgggtagggctatatccagtttagtctaataagacactcattttagagaacagggaaaaaccaattaaaaaacagaaaatacaattgttagaggaaagcagaggcaggctttggccccgcttgtggccagcacaggggccctcgctggcagctgccgcctggagggtgtgcacactggctcctgctggccgcagccctgagctcttcccacttccccgtgcccaggcccttcctgcgttcccttccttctgtctcctatacccgggtcttcatggcctctgagagagctggatactcccacagagaaggtatacgaaataggaccaagtgacactacacttcagactggatctcatccctcctggcttaaaaccgcctcgcccccagcctgttctccggaccaacagggtccagatcctcagtagacaccagtggccctttgacaggtggcctcacggacctctccagcttccacgggggcacctccctttgcaccccaccatcccaaaagggccagtgtcctctctggccaggcctgggacccactgctccagcctcagcccggcatgcccctgcctcagtgcctcatcccctgctgtcaggtcctgacccaacaagggcctgggctgctcatggggatgataggtggtttgcttgtcctctctctgcgacccctttgcagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggtaggtgcgcagcccggccctgcagttgtgggggcggggagccagggctggcccagggtaagggcggtggggcctccacctggggaagtgttgaggagggagaggggagcagggtgggcagacagaggggtcccgagagcaaggctgcagggcagaggtgggctgggggctgggaagcagccatggcaggaagcttctctctccagggctctgtttggggggcacttgagactcaggaggcgggtgggctggacccctagactgcagacgagggttgagatggagcagtggaagggacctgagggggcagggcaagagaccgggagtgggcttggtgctggtgttggagagaggagttgcataggcagcccctcagcccccgtcctcgcccacccccaccgtcccctccagtcctctccgtgcctatccagacaccccctctggtttggaggaggaggggggcccaagaacagacctgcttctcagaggcctgggtgcagaacacagcccactcttctgggctgtgcaggaagtctgtgctccagggcctgtctggggcacaggaagtcttcaaagtgcccagagatcagaaggcgctgccgcctcggctctgcagggacagaatgggcccctcggggagccgtgccctggggtggaggcgctgctggcatgaccctgcagaagggcaggggtggcacctgggggctgcacgctgtcttccaggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggaggtgagccaggctggtggacacgtggcctcaggttggggggtgccccagctcagggtcatggtaagagccctaaagctcctccacactcccagcccagggcgggtggctggctcccaacgaggcccttcctcaggggtactgcccctccctgtgctcagccagggaccccagcctgcccacgggagccaggagacccgagtgcacacacacggttgggtagctgtgcccacctctcctcttccccctgctggcattctaagagactccaaggtcaggagaaaaccttgggggcagtctgtccagagtgcctgggggttgtggatgacagaacccgctgcatggacagccctgtgcagacacggagctgaagagttcctcaggtgtgagcactgggtcacctggagtgcccccaccgggtggtgggctctcatgttctcatgggtacactgggaacagtgagcccaccacctcccctgatgacctggccagcgctgtgtccggaagctgtgccttgggtggcggcttgggtgggaggccatgcggtcctgccctgatgcaggccccagcccccagccctcatcctcacatgcagatccctgggggaatgcaaggtgctgctcagtgatcccaggcttgcagggggtgcctgcaggaggccccacgtggacaggcagggccgcctctgcctatgagggcccaccatgccgcagcaccaggctggcacctgactcctggggctgaggctgccgagggggaggccagactgggaggggatggtgactcacaaggttaccatcagtgccttagaggaggggtagggtctgctgaccccagggcattcacagaggtgtcagtcccctctgcccagtgtgaatcctgaaaggcctgcacctgcccagactctgctttctgtccccttctgtcactgctgcctcctggggccactgtggtcccctggagtcactggctcctggggtcactgttgtccccgggtcaccactgtccctcggggtcaccgctctagccctgatgccacccggcccgccctttgtccttgcagcactttgtctgtgccaagtgtgagaagccattcctggggcaccggcactatgagaagaagggcctggcctactgcgagactcactacaaccagctcttcggggacgtctgctacaactgcagccatgtgattgaaggcgatggtgaggccctgtgttccctcccccaccccacctgctctcctggggcctgggtgctgcagctgtgagcccagccgggcctgcggcagcctagccaggcctgctgagtcccacgcttccctcacagtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaac

SEQ ID NO: 11273 - DNA, 1137 bp, Homo sapiens
  ENST00000494613
gttggagggccaggctggctgcatgatggccctgggctggggtgtgactgcctgcagctactctgacagcctgctcggcccacagctcttcggggacgtctgctacaactgcagccatgtgattgaaggcgatggaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 11274 - DNA, 1678 bp, Homo sapiens
  ENST00000409286
gtgacagggcagtctgctttcccataccctgggctgagcccctttgaagcccccagctgctcagtgaagttgcaggggtctggcctctcttctcctggaggtggccaggctgtgtgggagtgggggctctgcccctaatgcccccgcctcccgcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 11275 - DNA, 1620 bp, Homo sapiens
  ENST00000409754
cagtgctgtgcaggatggagtccagacacccagcagtagcagaaatcgcctgtacgtgtttgggcccttcttcatctggcaaaccccgaaggaagggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 11276 - DNA, 2269 bp, Homo sapiens
  ENST00000476932
gcccgcgacctcaaggcggctgccccgcgccatggcggcccggctgggtgcgctggccgcgtcggggctgtaccggcggcgccagcaccggcagagcccgccgccagccacgggcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtaaggccggtgacagtacacatcctgggctgcctgggaagtgggcagcagtggcggggggcagggggccgagggggtacacagaactggcccagctctttcctaactccccaccttgcctctctgagcggcagccgtcaggccccctacaggcatcaccatcccacgagggagcccatgggccaggcagagagcaggcggagtgctaggtggacagggcttgggagggtccgaagaggggacaggcacgtgctccccagccagcagggacctgtcttcttccaggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 11277 - DNA, 2111 bp, Homo sapiens
  ENST00000324938
gcgtaacgtgagctcgcgaccagcgcgggggaggcgcccacacgcccgtcccgtcttggtgtctggccccaggcggccgcgcctcccctccgaggtggtcccatagcccctgcaccaggcggcccgcgcccgcgacctcaaggcggctgccccgcgccatggcggcccggctgggtgcgctggccgcgtcggggctgtaccggcggcgccagcaccggcagagcccgccgccagccacgggcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 11278 - DNA, 2099 bp, Homo sapiens
  ENST00000484252
caaagtgcccagagatcagaaggcgctgccgcctcggctctgcagggacagaatgggcccctcggggagccgtgccctggggtggaggcgctgctggcatgaccctgcagaagggcaggggtggcacctgggggctgcacgctgtcttccaggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccaggtgagcccggtgcagaaccttcagggatgcgggtctggaggggtggccaggagagctgccgtgagcaagggaggctgtgggcaccccctcaggagctctgccaggtgctgagcccaggcctgcaccctcagccctggctcctggcctggggtctcgagacctgggcagctctcttcagtctcagtgtcttcctttgaagaatgttctggggctggtgtgaggtcccgggcacatggggctgacagtgccagcaaccccctccctcccttgctctggtacagaaggcagggggcgctggtgggatgcagtcaccacctgggcccacctccttgcaggacagcagtggccagagcagaggggccttctggggagcaacgccccagcctgttgtccttcccggaagggtggttctcatgggttgccgtgccctcaacccagccttgcagctgggccctgggaggcagggcctgggagatgcctgagaggggccgtgttggagggccaggctggctgcatgatggccctgggctggggtgtgactgcctgcagctactctgacagcctgctcggcccacagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 11279 - DNA, 2592 bp, Homo sapiens
  ENST00000466410
gtggtcccatagcccctgcaccaggcggcccgcgcccgcgacctcaaggcggctgccccgcgccatggcggcccggctgggtgcgctggccgcgtcggggctgtaccggcggcgccagcaccggcagagcccgccgccagccacgggcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccaggtgagcccggtgcagaaccttcagggatgcgggtctggaggggtggccaggagagctgccgtgagcaagggaggctgtgggcaccccctcaggagctctgccaggtgctgagcccaggcctgcaccctcagccctggctcctggcctggggtctcgagacctgggcagctctcttcagtctcagtgtcttcctttgaagaatgttctggggctggtgtgaggtcccgggcacatggggctgacagtgccagcaaccccctccctcccttgctctggtacagaaggcagggggcgctggtgggatgcagtcaccacctgggcccacctccttgcaggacagcagtggccagagcagaggggccttctggggagcaacgccccagcctgttgtccttcccggaagggtggttctcatgggttgccgtgccctcaacccagccttgcagctgggccctgggaggcagggcctgggagatgcctgagaggggccgtgttggagggccaggctggctgcatgatggccctgggctggggtgtgactgcctgcagctactctgacagcctgctcggcccacagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 11280 - DNA, 2500 bp, Homo sapiens
  ENST00000409455
aagtgcatgactcaggactgggtgggagggggctgtccctgaggccctggtctcccccagccaagtcctggcagggggatgctgttcttcaggatcccatgacctggggctcttggggagccccagcccggagagtgacctgtggctttgctggggaaaggggcttggagggtacagggcagtgtccaggattgcagtctcaaatccgaggcccacaggggagctgcctctgtgatcgccattaaggctgtggcctggggtctcagggcagcccaggaaccaaaaatagcctgtaacttgtcactttgtaagtcctgccctccagacacacttccctttcttctccccaagcctctcttcccagttagctcccctgacttggagtcacctctaagccttggcccaggcccctctgcagtgagatggagggactcatcccccggagagtggcatctgcaggcccactggctgcctgtggtcaccccctagggttctagcggggctgcctcccattttcctcagagcatccctgccagctggctggttctcactctcctgttttctaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 11281 - DNA, 2045 bp, Homo sapiens
  ENST00000355119
gccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 11282 - DNA, 2315 bp, Homo sapiens
  ENST00000409808
ctatactcccgcaacctcccaccgtcacctccccaacacccccaccaccctcagccttgacctccccatcccaccccgccccgcgggccccaccctgccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagatgaggtcaccagaggccacagaggctgagccactcaggaggccagtcacaggtccaccagtgtccggccagtgtttgtccctgcagccctttctggaacctagctgggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 11283 - DNA, 2335 bp, Homo sapiens
  ENST00000410011
ttttgcagtctgtccgtggatactgtgaacatcaggctactcggccgggctcctgcgctcagggcttcgagaaatgctcattttggggctgcccctctgccggcctctctggattcagagggcagccgctgctccttttgttttgtgggcctggctctgggcccggagcagcacctccctggggaggccgcctttccttccgcggcttcttccgtctcctcctgaccccaaggtgcctccggcctctgcctccagctaaggacctctggccaagcctcctgcccagggagaggtgaagctgccgtgcctgggtgccccgtggtggccggacactcctggcggctgctcagtcttgcacgtggctgtgccaagcgggccaggcagctgctatttccctcagagaagttgctggcggcgctcagggaaggaagcacccgaggaggcggagcggcatctcagccacagagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 11284 - DNA, 1695 bp, Homo sapiens
  ENST00000410038
aagatgcctgaagttctaacaccagagatggtttcctgctgcttccaggaacagggtctgttcttagtccaatgtggagttcctcatggggaccccattccccaggaatccaggttccacagtactctgacttggtctggctggtctcggctggcactttccctaggactgctaaaaccacggtgagggcggagagctgagggccgaagaaggcggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgttt

SEQ ID NO: 11285 - DNA, 1730 bp, Homo sapiens
  ENST00000545738
gcgctcggctggcggctgcagcagcagagggagacccgcggcaaccccggcaacccagggctcggcgtcgctgccaccatgacgggaaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcct

SEQ ID NO: 11286 - DNA, 930 bp, Homo sapiens
  ENST00000413578
gcattctgaacttcagcacaaggcaaacgcagaaccagggcttggaatttcgccgctatgcagctgcacccctgccacccaggagatctgaggctcctcagagctgggaggaccgggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtggcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacagg

SEQ ID NO: 11287 - DNA, 867 bp, Homo sapiens
  ENST00000409254
gcattctgaacttcagcacaaggcaaacgcagaaccagggcttggaatttcgccgctatgcagctgcacccctgccacccaggagatctgaggctcctcagagctgggaggaccgggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacc

SEQ ID NO: 11288 - DNA, 531 bp, Homo sapiens
  ENST00000582671
ataggcctctgtggaggtggcaggtgggcatgtgtggcctcggggagggcctgtggtggcagcgccatggccaggtggtggcagtttcctttgcattagcgccactccatccctggcccgagccctctcccaggcatctggctcctctatgggtcaaggctgcctaatggttaggggcagcggtgctgtcattgcagcctggactgccggcaagccacttcccctctgcaagcccccatcagagggacgaaacaccgctttgtgggctgctgtgaattcagactgtggtcagccttcgatgcacaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgt

SEQ ID NO: 11289 - DNA, 5505 bp, Homo sapiens
  ENST00000345080
aattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcattta

SEQ ID NO: 11290 - DNA, 2635 bp, Homo sapiens
  ENST00000637759
gtctctcgacctccgcgctccctcaggaagtgacagactccaggccccttcctccgccccgtccttcgggactgaacgccacacacgtcctcacaccctctccccctctcacacccaggctagcgacgcgaccatgaggccccggaggttcttcagaagaggatgaggtcattcaaccaggtttcatcagccccaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccacc

SEQ ID NO: 11291 - DNA, 912 bp, Homo sapiens
  ENST00000635857
acagtccagaatcgacccggaagccttcagatctgacaggatcgcactgttgcccagggtggagtgcagtggcgcaatcttggctcactgcaacctccgcccccctgctggagagatcctcccacctcagcctccccaatagctgggaccactggcgcgcagaccacgcccagcgaattttttgtagagagccaggtcgccattttccacaggctggtgttgaactcctgggctcaagcgattcgccacgtcaacctctgaagaaggtgctgggattacaagcatgagccaccgccgccaggttcttcagaagaggatgaggtcattcaaccaggtttcatcagccccaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactct

SEQ ID NO: 11292 - DNA, 6112 bp, Homo sapiens
  ENST00000552864
cggatacctgctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctctagaaaaataaaataaaatcaccaactttaatatattcccataggtaaatagacaatgagatatcatttttcagaaaatatcattcactggaaaataatctgttataactacatttacaggtcataatttttggtttatggtaaatctaggcacctaagtctgattttactttatgaaataaataggaagcaataattgtttgggcatttgaataccttaagcacataaatgaacctaagaaaagaataattgcttagttgaagtattcaaaatagatcagtaaaccacaggcaaatatttgaatgttcccttttctcaaatacagaaattgattccccaagatacaatacaatttgacacttcagataatcccccaaaatagaaatgtatgaagctcagtttagactgtcttcttgaaaataaaacaaaaccaatcaaaactacccagcacattttattatgccctgttgggtgatagtattgtcaataccaggttttccctgctcttcacaatgcatccctcaccagaggaaaaacagcaagaaaactaggacatttgctaatttcaacaatacacccctgtgataacagattcccatccttgaatacatatcattttttactagagagaacgggggtggtgaggtgggggcagttaggaccctgtatgttatgtaaaatagatttacaaaaaggacaagcatgataaaagggaatgaatggagacgatgtattattcagtttgaaagagatagttcacatttttataagaaaaatttaataaaacatatattttagttatcatttaacaaagatatattaaagctattcaggcaatgccacaggattctcatgaagggaaatcactgaacccttgtcatgagaaaatggtcatttcaacacatttcaatacattgtataaatttggagcttaaggtgagtgagtatgttttcacttagtcataaatgtttggtcaaaattaaagttatcatatggtttcacatcaatacaaatattgtcacagtgttacagaaacaactatcaaatggtaagatagtttacatttgtgttttctagaaacctttgtatttatgcttcatttggttaatgttaagtgctgataaaggcataccagattgtttgtcaaagtaaagaagcaatccatcacacctaggacatctaaggatggattatacgtcagagtggtctcatatacaaatgaccattttccttcagtaaaatcttgttggttgaaatgtaagtcttttcctaaagttttaatcagaggtagccatcactaagacttaagccacctgtggttctcttaagtttcactgaagccagaagaaggaaattaccacaacttgtattatactaattatcttcattattaacgatcatattagagccactgacatgtcccaaattatattaaaataaaaacctgcattgctctgacatgaagctcaattcaatgtaataaacaaattaggtattaaacgttataatttaaaaaacttctacgatatcaccagaaatcctggtgaaatttaattttttcccttttttaggtcagtggccggtgggatagatttttctaaactttttcctgctatgattttgaaggcaaatacatagagcacagttcagtaaaagagtttccaagccttttcactggagcatttacattttgattctgttgtcatttgaaatagaacatctgcagggagataatgagcttaagttacaattgactttggaaagaataacagacttttgtgtttcctcaatcatgtagtcaatagggaattctccagttatgtgaacaatcacagtcttttaagacaatacttagatctaaatgcaaaatctagcatgcagaggctttttaaggattttagactgtctccaaagaacttggctcgagatggattacacagatttacaaatgcagttttcaactgtgacatcaaactgatcttatctcatttcatgttactcaactgtgcccgtaggaccccaagaggtggaatattttgtctacattattttaaacatctatagatatgtgtggatgtgtgaataatgcctaaatttctcatcttttaactagtttgtttttatcatacagacacagcctgttcataagaccagctttagacaacttagaactcaatgctctgaagattcagggaggccaacatagaaaaagatcttccaaaatatggggtggtccaacccatctcatccctctctagctggaaaactatagagaaagggctgtgactgccttgaccactgcctggcacaatgtaggcactcggtatttgttggatgaataagtggctgaatcagtgaatagacaaaaaacatggattttgccttctgaaaatctcacaaattttaccagcttatattatactgattgtcactatgatttctaagtttcatggttagaaccatattttgagtctatataaaaactttttagatgtatgaatttgaaatttcattaattactttaaaggcttcaaagatttgaggacatttgaacagtggataaggaacaatgtttggggatacagagtttttatgctgagttgaactcaacctttctagttctttatacaagcttcctgaattatctggcaggaatgattcaaacataaaaccccatttttaaattttataaaagatattttcatttttatataaaaagatcatcaggcatattatcccctttgatatttattaacaaccattctctaagaaattcataataattggagacaccatccctaaatctcttcctattttcaaaagatcatttatcctttcatatttgattcctggaatacactaagctgaagtttaatcacatacttactcagatgtttccatgtgtttattcatttaacaaatacttattgtgtacctagtgcatgctaggttctggaaatgcaacagcaaacaagacagacacaatccctcttggaggttactgtgagaaactctccaacatttactctagcaataactagagagtttactgtccattgggtcctcttcacacctgatagaaaaaataaaattcctcaccccatggaagtcatgaaatactccctgcacagatttgtgtgagcttgcttttctaaaaccactgctcaaaaatgctgcttagtttatctataaaccacggttataccccagtgaggtaggtaagtaatttattcataactaacatttatgcagctctattttctagccactgtgctgagtgcttttatggactatctcaccaaatcccttcaacaactctattcagtaggttccattttatagatacaaaaactgaagcacagatatattatgtgacttgtccaaggtcacacagctagcaggtggaactgggatttgaacccatgcaatctgacacaagagttcatgtgtctaatcattatctgtggtttgggggacaccattacattaaaatgaatgagtcactaagtgagtcactgtatataaaatacttggaaattgtaaagtaatatacaaaagatattaacaaagtattattcatggtaaacaaatcacatcagtagcaaacacagggtgggaactcaatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacaccaaa

SEQ ID NO: 11293 - DNA, 989 bp, Homo sapiens
  ENST00000261203
tccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggtattctcgtgtgtacactgtaagagaatttagacatcagtggcagcccagagtctagaaccagtactacttctcaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaa

SEQ ID NO: 11294 - DNA, 905 bp, Homo sapiens
  ENST00000549417
acttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgcttctaagaagtcaaaaacagatggaaactcatgtcagctcagcaatcattgggagagaaaattttttctatccctaggcaccaagagaaatttcccatgggaatgttacaaatgagacattgaaccacctaatacaattccatagaaaatacagaggcctttggtgtatggctacttcttatatcaatcctcagtgaaaccttacaactgaatgctgaattaaaatttaacattaataggaggtcaaaatgttacagtaagaatttatagctttctaatgatctccttttcacccttttatgctcaagtgttttctccgcaattttaagagagaactcaaggactatttataagggttgcagccaatgtggagccagcggcaaccgtaaatatatttagtgatagagtcaggatataaaaagtctcaatagaatggtac

SEQ ID NO: 11295 - DNA, 546 bp, Homo sapiens
  ENST00000552093
tactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtggtatgtttataaaataaccagagattttctccttaagcacattctttttttttgccccctgctattactgaagtcaacgttgaaaacctagaataaatattcattttatgtctaaccagctttctaagcattgatggatattaaacctataaaagctgcaatctaa

SEQ ID NO: 11296 - DNA, 462 bp, Homo sapiens
  ENST00000418518
atgaggaaacccaggcctggagaggtcaagcaacttgctcaagtggcacagctggagagtggggagctgggacttgagcccaggtagtgtgtccccagcaccttcaactaaactccattctgtgctgccctttggaacacccactcaatggccttcacactccatgtcctacttgggaggacatgtgatctcaacagcactcacaaatgaaggctttccagacaggatattgaagatgggaggtgtgagctgtgggagagagctgactaagaagaagaaactccccagaaaggtggcctgccagtcttcacgatgtatgggagcaggtgggaaaagagctgcaagtgtttgcacttcatcattgaaattgttgaaactgctgatcaggaaacacagaatgagtttaaccagcgatgccaacttctgcaagatggactccagcttgggagctctgtatggaat

SEQ ID NO: 11297 - DNA, 587 bp, Homo sapiens
  ENST00000444263
aatctgctgagctggtggccacctaaatacaatcgtcctgttcccctcattggtctctccggtctcctgattccagccacattttggtgagccagccaggagtgaagacgacaggtttgctgtctcctttgcctgtgggtctggggccccagcctgggggagacccgtgactccaggcatgctatcaggacaacttcaacccgaggggagatcagctctcccgcaacctggtgccgctctctgacagcacaacagaacctaaggggctacaggatgattcaaggaacagtgtgctacaggacctcgcaagaagaccctcaccagatgcagcccctctatgttggacttcccagcctccggaagttagaaatgtgctacaaccactcaaggtctgcaaacagattcctatttagatgttgttgagaggtaagtacaactagttctcattaatatttcatgtcctatgtgccatacttacactgccattttgtagtcatttgtcctacagctaaagattaatttataatcagatacgtgaaatctgatatgtgcattaagcttgattatacctgactgtgtcttcacga

SEQ ID NO: 11298 - DNA, 528 bp, Homo sapiens
  ENST00000425031
gtgagccagccaggagtgaagacgacaggtttgctgtctcctttgcctgtgggtctggggccccagcctgggggagacccgtgactccaggcatgctatcaggacaacttcaacccgaggggagatcagctctcccgcaacctggtgccgctctctgacagcacaacagaacctaaggggctacaggatgattcaaggaacagtgtgctacaggacctcgcaagaagaccctcaccagatgcagcccctctatgttggacttcccagcctccggaagttagaaatgtgctacaaccactcaaggtctgcaaacagattcctatttagatgttgttgagagctgaatttctggaacaagagatatagattaagactgttgttacatgttgcctacatgactttcaaaagcttgattcccagtggcgctctcaacagcagtcataaacaatggtaattcaatgtatatttatattcaactgatatattaattggaatatattaaaaatacgtatatttatattcagaata

SEQ ID NO: 11299 - DNA, 394 bp, Homo sapiens
  ENST00000440160
tacaagaaatgcaatcagggggagcagaatgacgcagaggagtctggaagctcaggattgcattaagcgactttcccatactgtgaggagatgtggtggggaccattaactgttggaaggattccttttaaggatgcattatatcaagagctagatatcagagccacttgggagaaataagaaacaggtgtagaaacagtcgcagattggcatgagctgtggagaaagagtctggattctgggttgctgtgtcacacacagcccacttgcaggatgacagtggaagaatgagtcatgatctctgcaagcgcccatcaagaacagcctgagaggtctggaaagtgctcaccccaggacccttcatgtccttattaaaattgtatggcagaaaaaa

SEQ ID NO: 11300 - DNA, 413 bp, Homo sapiens
  ENST00000428706
cattatatcaagagctagatatcagagccacttgggagaaataagaaacaggtgtagaaacaggattggtagacaacatgttcatgcaaatgatatgaagaagattggcacctggaaaatcaaggaagaggtggggccgtgtaggcagagacttaattttctcaagtgaatgaagaaaaaagcacatggtgaggctgattctgtggggatgtatttgagctagaagattcaggagggaaaattagttctaagacaaagatggagacatcaataagattgggaaatactcagacgtcagaagaatttgggtttgaatcagaattcctttacatactttctaagtttcaagttaagcagcaattcagtgtttcaaaccttacgattgataaacaaaaaataaaatgaaattcacc

SEQ ID NO: 11301 - DNA, 567 bp, Homo sapiens
  ENST00000502757
atataactggaactctgggaatgtaacgggcatggtgtgcttgtctgatggacagggcagcttaggggaataagtctctgcagcgttgtagtgaagagagaatacgggacaactgcaggaccacagctcagccaagacacaaccacatgactgaagacagagatcatctgggtcagtgtttcagaaaatgttgccaagaaacttcaaatgcagattcctggacctccgtgcaaactactatattagaagtgagagtgggggtgagatggaggagaggtgatattgagaacctgcattttttaaaacttttattttagtttcaggggtacatgtgaaggtttgttatataggtaagctcatgtcacgtgggtttgttttacagattacttcatcacccatatattaagcctagtaccgaatagttcctttttctgctcctctccctccttcaaccctccatgctcaaacagaccccagtgtctgttgttccctttatgttcatgagttctcatcatttatctctcacttataagtgagaacatgtagtatttggttttctgttcctct

SEQ ID NO: 11302 - DNA, 540 bp, Homo sapiens
  ENST00000507145
tataactggaactctgggaatgtaacgggcatggtgtgcttgtctgatggacagggcagcttaggggaataagtctctgcagcgttgtagtgaagagagaatacgggacaactgcaggaccacagctcagccaagatgagctcaagtgttgcaagtatctgcttaaaatgccatgtgatgctaatcatctctgcacgagcagttcatctcatctctccagtaaattgcttatcacagtaaaagtaggacctcctgcttcagactctaagcttccggagaacaggaactgcatcttttctatttcacatacccaactcctcacacaatgcatgatgcaagtgggaatctacataaaatatctgatggataaatggagtagcactgatgcatatgagacccagtgttaaccagaggaagcaatcaactccaagatcaactgccaagataaaaaccaggaccaaggaaagcttctgagataaaatgatttttaagattaacgtagtggatatttccaattgttttttttatacccttcatctg

SEQ ID NO: 11303 - DNA, 579 bp, Homo sapiens
  ENST00000515282
atggtgtgcttgtctgatggacagggcagcttaggggaataagtctctgcagcgttgtagtgaagagagaatacgggacaactgcaggaccacagctcagccaagacacaaccacatgactgaagacagagatcatctgggtcagtgtttcagaaaatgttgccaagaaacttcaaatgcagattcctggacctccgtgcaaactactatattagaagctcccttgcagctgagttggccatatgactgacagcaagccctggaatgcagccagaagtgatagaagcctctttcacaccatgctcctaaaatattccaagaaattttccaaacctactctttttagtctgtgcatctggaagtgaaagttttagaaagggtaaagtcacttaatggaaagggcccagatctagcccctcggagccaagctgtccaactagaaattctgcattagtatttgcgaccccagtaaaaaaaaaaaagtcccacaaagatgtaggatctcactttgcctgcgttaattccctgtcctttgcccagtttctcctctcttggaaggcagaggcagcttctgatttt

SEQ ID NO: 11304 - DNA, 587 bp, Homo sapiens
  ENST00000510736
atggtgtgcttgtctgatggacagggcagcttaggggaataagtctctgcagcgttgtagtgaagagagaatacgggacaactgcaggaccacagctcagccaagagctcccttgcagctgagttggccatatgactgacagcaagccctggaatgcagccagaagtgatagaagcctctttcacaccatgctcctaaaatattccaagaaattttccaaacctactctttttagtctgtgcatctggaagtgaaagttttagaaagggtaaagtcacttaatggaaagggcccagatctagcccctcggagccaagctgtccaactagaaattctgcattagtatttgcgaccccagtaaaaaaaaaaaagtcccacaaagatgtaggatctcactttgcctgcgttaattccctgtcctttgcccagtttctcctctcttggaaggcagaggcagcttctgattttgatcacttcatgtccagtaggacctcctgcttcagactctaagcttccggagaacaggaactgcatcttttctatttcacatacccaactcctcacacaatgcatgatgcaagtgggaa

SEQ ID NO: 11305 - DNA, 477 bp, Homo sapiens
  ENST00000432535
agagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggaagaacttataattcttcacaggtcacatagaagcatgagaatttgggttcaagcaagtaaattctaaatcagaatccatacataaagtgtttgcaatgtccagttatatctccatgatattttctttgtggaagttgattgttcttccttacaataaattgcttgaattgtctgtctattcatttagctatttcttttcttgtctttgcgatatttttttttgtaagtaaaaaattttcagactaaataa

SEQ ID NO: 11306 - DNA, 1403 bp, Homo sapiens
  ENST00000454968
ccggtgcctggggtctctggagggggtactcagagtatccgaggaggagactcctggatgctaacagagcccccagttaggagcagtccgcgagacagttggtaacagtgctggccttgcccgggcgccggaaggttccgtgaggcccagcaagtcctgacttggcacagggcccagcacacggcgcagtaacaatataattaccgtatgcagtcccccaggatacagggtcaaaggagagcacaaccatcgcagttggaagcccatggggcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaa

SEQ ID NO: 11307 - DNA, 1887 bp, Homo sapiens
  ENST00000444184
gcggccgcctctccacgccctgccccgggccgcccgccaggccgccgtttcccggagccggccccctcccgccctcgcggccggctgatgtcatctgcacacaactttccgcttcccggcccgtctcggggccctgagtcatcgccgcccccggccccgacgctggcctgcggcgtctgtttgtgcagagcgaggccccgccggccgggcttgacgtcaggctggcagggcctggaacggccccgcatcgcggccccctgggggcaggacgacaccgctgggggccgagggcagggcacgccttcggaatccggcttcgaagccggccgcctgacctggggcaagtgctttcaactctctgaacttcggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaa

SEQ ID NO: 11308 - DNA, 961 bp, Homo sapiens
  ENST00000608369
ggttcctcatctgccagttggcagacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagacccagacttcaccctcaggtcaccctcacctggactttggggtgccccacaccccgccccaggccctggcctctggaatatttggaaacttgaactgggccagaggcttaagctcacatctgtctggagcctcaactttctcctctgtaaaatgggctaacactgaaagaaccttgcagaatctcagcaacgtcacagaggacattgttagcacagccagcgggctcctgctgggctgagtttgtgggtaatccaagcctcggcaggtacagttcctccctcagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcct

SEQ ID NO: 11309 - DNA, 9557 bp, Homo sapiens
  ENST00000419300
ccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaattagccgggcgtggcgatgcatgcctgtaatcccagctactcgggaggctgagccaggagaattgcttgaacccgggaggcggaggttgcagtgagccaagatcgcgccactacactccagtccgggcgacagagcaagagtccattcccccaccaccaaaaaaaaaaaaaaaagaaagaaagatgatgtgatacatatcacatatttcctaacacccccaaccaaacacatttatgcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaagccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttttgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcacgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttagccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccagggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaagagttcaagaccagcctggccaacgcgacgaaaccctgactctactaaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaacacaagctcaggttagtaagtcattcaacaaacatttactgagcgcttatcaaatactgcatgctggagtggacactggagaaaaaggtgaggagaaggccgggcgcagtggctcgtgactgtaattccagcactttgaggggcagaggcaggtggattacctgaggtcaggagtttgagaccagcctggccaacatggcaaaaccccgtctctactaaaaatacaaatattagccaggcatggtggtgcatatctgtagtcccagctactcaggaggctgagcaggagaatcacttgaactcaggaggtggagcgtgcagtgggccgagattgcacctctgcactccagcctgggcaacatagtgagactctgtctcaaataaataaataaagtgaggagaaaaaaataccatctctgtcttcacagaacttatagtttgagaggggagaatcccacaagtaaattataaatctcagctgagattatgcaaagaagcaaaggccggacgtggtggctcacgcctgtaatcccagcactttgggaggccgagacgggcggatcatgaggtcaggagattgagaccatcctggctaacacggtgaaaccctgtctctactaaaaatacaaaaaaattagctgggcgtggtggcgggcgtctgtagttccagctactcgggaggctgaggcaggaggatggcgtgaacccaggagcacaggttgcagtgagccgagatggcgccactgcactccagcctgggcgacagagcgagactctgtctcaaaaaaaaaaaaaaaaaaggaagcaaagtgcccagctgggatggtggtttcagaggccacagtgggagcttcccagagaagggatgattgagctaagtctaagcaaaaggggtggtcagggcagcagctgctccaaaacaggggctgggggcttatgtggagagagaagacatggagagaccatgcccagaaggaggcggcggcttcagtgaacagtgcaggggagcaggtccgaggaggccgcctaccaggggaaggagtctcatctccatcctagacaaaaaaaggatcttttgagatgcattaagcaggggagtcacagattggatttgtgttttgagaatctcctgcttacctagagaagaagggcatctcctgggccctcactgttgccttaaatgatttttattgtgtattacttaaacatgtgcaagcataaaatgagatataaactccttgtagctcttatacaagcatcagaccaagacaaattgacccatcacgtacaaaatcgattcaaatcagattaattttatgtgacatgttattatgccttttgtctgaaaccctgccaccacccacagtgcaattatggcccaaccactgtggtgttctgaatttgtgggacagagaatattggccttttaaacacgtgcatgcatgcatttgcgtgtgcgcacacacacacatcccaaatgattttttcccactatatatgaagaactcctacaaaccaaaaagaaaaaggcagacaattcaagagaaaaatgggggagggcttgcattaaagtacttcataacaagagtacttaggaggccaacaaatacacgaaaagctgctagcttcatgactcatgggggtggcttggtcagttcaggatactgtaacaaaataccttagactgggaaatttataaacaacggaatttattgctcacagttctggaggctgggaagtccaagatcaaggcagcagtagatccggtgcctgagcccgttccctgcttcaaacatggcaccttcttgctgtatcctcacatggtggaagggggaagacagttctctggggcctcttttataagggcagttatccaattcacaaggatagagccctcatgacctaatcacctttcaaagatccccatcttctaacaccttctaacaccatcaccttggtgattaggtctttttgttgttgttgttgttgagatggactctcactctgttgcctaggctggagtgcagtggcgtaatcttggttcactgcaacctctgcctcccgggctgaagtgattatcctgtctcagcctcccaagtggctgggattacaggcgtgtgccaccatgcccggctaattttcatatttttagtagagacagggtttcaccatgttggtcaggctggtctcgaactcctgacctcatgatccgcccacttcgtcctcccaaaatgctgggattacaggcatgagccactgcacccagccgattaagtcttaacgtatgagtttttgggagaaactcaaacattcggacaatagcaaggagaatacaaaaccacagtgagctaccgcttcagacaccagagaagtttaagtgaaaaagactggcaataccaagtgctgatgaggatatggagcaaccagaactctcagacattgctgatgggaatctaaattagtataaccaccacgaaagcatccgtaaggtttaattgtgttgaacacaccctgccctctgaccaagcatttccactcctgggcatacaggcaaaagaaatgcatccacgtgttcatcaaaagatgtaacctgtgccaggtgaggtggttcatgcctgtaatcccagcacatcgggaggccaaggagggaggattgcttgagcccagaagttcgagagcagcctaggcaacaaggcaaaacctcgtctctactaaaaagtagccaggcatgatggtatatgcctgtagtcccagctactcaggaggccaaggcatgcagattgattgaacccggaaggtggaggctacagtgaattgtgatctcgccactgcactccagcctgggtgacagagcaagatcttgtctcaattaaaaaaaaaggaagaaagaaagacataacctggaatattcacaccaacactattcaggatagccctaaactggaaagaatctgaatatcctccggctttagaacagagagaaattatagactattcattcatacaggggatgattgatcagctttaagaataaacaaaccgtacacaacaatatagatgaatctacaaccttaatgtgcaaaatagttcacatatataaaggacaaaaacaggcaaaactactccatggtgttagaaataggggtagaggttaccctcatgcggcaggagggttagtgataggggatttggaagaggaggagcccaatggactgaacagctgagctggaaacagcaatttgttccttaaagttctgaacccaactgttatccagcatggagtctgtctggagaggccagatgtggggcctctcacaggggaatgagaagtgcctctcagggtcccacccatgatccccctttccttgcccacacaaccaccaactggcaagtagtaacccaggacctgtagcccccactggcttgacacagagcataatgcaagcttttcctgctccaggtcctggacaccactttgccctttgccccacacgtacagccccctgaccaaaagctgggtactctggcttgactagagggagctagactccaggaataagtaaggagctgggcttccacgctagagaacaagagcttctctggggaaaggggcttcccatgaagccctggggcactgggagattaatgggcagacctctggcctcagcttccagggaaggggagggtgtgggccaacatgcggtggctacactgaccacaagccgatgaccccagccagcctcaggatgtctcagctctaggcatggtttttcgttttgttttgtcgtgttttgtttttgagatggaacctcgctctgtcgcctaggctggagtgaagtggcaccatctcgtctccctgcaacctccacctcctgggttcaagcgattctcctgcctcagcctcctgagtagctgagattacatgtgcgtgccaccttgcccagctaatttttgtatttttagtagagatagggtttcatcatgttagctaggctggtctcaaactcctgacctcaagtgatctgcctgcctcagcctcccaaagtgcaaggattacaggcatgagccaccatgcccggcataggcatggttttgacaatctgtctctttgtgccctggctccttctccaactcctctttggaggaggcacaggaggaggggtcatttcactgttcctgaaaagtagacatataacctacatgcaactgccaggtgataagggccccatctgtctggcatgacgttggaggtccacaaaggctgattagatgaatgctcagctctggggcctccccacagagctcacagacaggcgtgaaggaaagcaggactcttattagaatatgttcagagttttcactgaagaagcctcctgtgtgggccaggcactgtgctcagtgctttgattcacagtctcatttaattctcaccatttacagacaagaattcagctaagatccttttcaatcaagtctggcaatatctgcctttcaatggcagtgcctagtcctttcatatgtaatatacttatcattatgggtgggtttaagttttatcatcttgctatttgttatctatttgtcccccctcttttgttcctcctttactgccttctatttggttgagacttaataaaatattttattccatcttctcta

SEQ ID NO: 11310 - DNA, 1654 bp, Homo sapiens
  ENST00000423918
gtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgctgggattacaggcatgagccaccgtgcccggtcaatttttatattttttgtagagacagggtttcaccatgttggccaggctggtgtcgaactcccgacctcaggtgattgtcggccttggcctcccaaagtgctgggattacaggcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaacctt

SEQ ID NO: 11311 - DNA, 910 bp, Homo sapiens
  ENST00000454635
ctcactccctctattgcctctccagacccagacttcaccctcaggtcaccctcacctggactttggggtgccccacaccccgccccaggccctggcctctggaatatttggaaacttgaactgggccagaggcttaagctcacatctgtctggagcctcaactttctcctctgtaaaatgggctaacactgaaagaaccttgcagaatctcagcaacgtcacagaggacattgttagcacagccagcgggctcctgctgggctgagtttgtgggtaatccaagcctcggcaggtacagttcctccctcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacg

SEQ ID NO: 11312 - DNA, 830 bp, Homo sapiens
  ENST00000625171
taaaatgggctaacactgaaagaaccttgcagaatctcagcaacgtcacagaggacattgttagcacagccagcgggctcctgctgggctgagtttgtgggtaatccaagcctcggcaggtacagttcctccctcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaa

SEQ ID NO: 11313 - DNA, 261 bp, Homo sapiens
  ENST00000624138
tgggtaatccaagcctcggcaggtacagttcctccctcagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcc

SEQ ID NO: 11314 - DNA, 663 bp, Homo sapiens
  ENST00000624009
tgggtaatccaagcctcggcaggtacagttcctccctcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccgcctgggcaacatagtgagactctgtctcaaataaataaataaagtgaggagaaaaaaataccatctctgtcttcacagaacttatagtttgagaggggagaatcccacaagtaaattataaatctcagctgagattatgcaaagaa

SEQ ID NO: 11315 - DNA, 444 bp, Homo sapiens
  ENST00000622972
tgggtaatccaagcctcggcaggtacagttcctccctcagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcagatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttgg

SEQ ID NO: 11316 - DNA, 472 bp, Homo sapiens
  ENST00000624390
tgggtaatccaagcctcggcaggtacagttcctccctcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaat

SEQ ID NO: 11317 - DNA, 781 bp, Homo sapiens
  ENST00000622680
cggtgagccgagatcacactattgcactccagccttggcaaaaagagcgaaactccatcccaaaaaaaaaaaaaaaacaaagctgcagctcagagaagtggagacactggcccagggacccacagcaaggccttggcccagctggggctagatggcaagaggtggttcagcattggagctccattgcctgggttcaaatcggggtctgtcactggccagctgtgagcctaagtctctgaacttctctgtgccttagtgtcctcattctgtagagtggagatagtaatcattcctatttcaaagattgttgtgagaaataagtgaactaatacatgtcatatgcttaaaagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgccc

SEQ ID NO: 11318 - DNA, 786 bp, Homo sapiens
  ENST00000623185
cctgttgcctgcaggccagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcagatgccgttccattgtttgctgactttcattgattctatgagaagtctgcagtcttttgcagcgttgttttcctatgtataattgtctcctcccaccccactcaccccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagca

SEQ ID NO: 11319 - DNA, 473 bp, Homo sapiens
  ENST00000607931
cttccggagagacggagagctcctagaagcagcgcctcccagcagaagcagaatcttgccctggggaggagtacagctcagaacccgcagactcggggtcaaatcccagctctgtgactttcttgatgcgtgaccttgggaggcagctttgctgccctgagccctgtttcctccccggaaaacccataataataactgtacctcttccagtgaggagacaaggtggaatagaacgcagagcccacgtgtgcctggcacttgacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacgg

SEQ ID NO: 11320 - DNA, 355 bp, Homo sapiens
  ENST00000622120
gcggaaagggttaacgggctccgccgcattgggctgtccttcaaggggggagccagccaatgagcgcgcgccgcgatgagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatgg

SEQ ID NO: 11321 - DNA, 612 bp, Homo sapiens
  ENST00000608272
gggctcccgagtgtggggagggcggctcagcaggagctgctgcttcccagaaagttgattatttttaacccaggaagaagaaaggaaggaggcgagggagaaggactcagagaaaagaggagaggaaaagagaggagaggagaggaaagaaacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgttttgttttgtttcgttttttgttttttttttttgagacggagtcttgctctgtcgcccaggctggagtgcagtggccccgatctcggctcaccgcaagctccgcctcgcgggttcatgccattctccggcctcagcctcccgagtagctgggactacaggcatccgccaccacacccagctaattttttgtattttttttagtagagacggggtttcactgtgttagccaggatggtctcgatcccctgaccttgtgatccacccaaggcctcggcctcccaaagtgct

SEQ ID NO: 11322 - DNA, 469 bp, Homo sapiens
  ENST00000453213
gacatggtgggggcagccaggaacggtgtgccagggggaggaacagcttgagcaaaggtgcagagaggagacaggcaaagagaaccacatgtgacatggtgggacatgccggaatcttccagagagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcaga

SEQ ID NO: 11323 - DNA, 382 bp, Homo sapiens
  ENST00000427778
tgctccaggaagaggaaatctacacataagaaggtctcaaagtgggagaacagggtaatctagaagaactagagaaacttaagcagctgtgtcaggtcaaacagtgggtgggaatcacgaggctggagcccagctgatcaggaaggccgtcgagtgccaggttgagagctgggacttatccccaggcagggaggcctattgggagactgctctgagagtccagctgctttccacattctctctctttgattttcagcagtctgcccatgatgtgcctaaataggactttctttgcattcatcttggctggggctcactgaactttctgaatctgtagattaattttcttttttcaataaaccttggaatattttcagcataa

SEQ ID NO: 11324 - DNA, 531 bp, Homo sapiens
  ENST00000608669
gcagctgtgtcaggtcaaacagtgggtgggaatcacgaggctggagcccagctgatcaggaaggccgtcgagtgccaggttgagagctgggacttatccccaggcagggaggcctattgggagactgctctgagagtccaggcaagtggggctgtgttgactgtgaggatgtggaatggagtggggctggaggactggagaggccctcaagagttgtagaaagagggtctcctctgatgtggagctggcctgcaagtgtgatgctgttccagacagagagaacagcatggacaaaggctttcttttttttttttttttttttcagacggagtctcactctgtcaccaggctggagtacagtggtgtgatctcggctcactgcaacctccgcctcccaggttcaagcgattctcctgcctcagcctctcaagtagctgagattacagacggtttcaccatgttggccaggctggtgtcgaactcccgacctcaggtgattgtcggccttggcctcccaaagtgctgggatta

SEQ ID NO: 11325 - DNA, 739 bp, Homo sapiens
  ENST00000412141
gcgtgagccaccgcgcccagccggtgggcagccagttgtgttccgggaggaggaggacaccctggaaagacagtggggccagacactgaactgcctttggaagcaagtaggagcaacagcgaaggtttgctggctcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcgtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcagatgccgttccattgtttgctgactttcattgattctatgagaagtctgcagtcttttgcagcgttgttttcctatgtataattgtctcctcccacccca

SEQ ID NO: 11326 - DNA, 276 bp, Homo sapiens
  ENST00000451690
tgaattaatctgttcagaatgaacaagcagaatagtctttggatttgatccaaatccctgaagcactttgggaatgagaatggctatgccagacagagagaccctggcgacttatgatactgcagaacacaacaggcacttcagattggtcccaggcaaaagaaagcagtatagagatttattctcccactggcatgaaagctgtgattctgaccaccttctacatcactgtctaccacccctacaccagctcttagaagacagagtaactacagg

SEQ ID NO: 11327 - DNA, 637 bp, Homo sapiens
  ENST00000413121
gaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagaca

SEQ ID NO: 11328 - DNA, 675 bp, Homo sapiens
  ENST00000443988
agtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagac

SEQ ID NO: 11329 - DNA, 607 bp, Homo sapiens
  ENST00000447876
ggagggtgccggtcagcggagccgtgcgatgtatttgaaaagcaatcagtccgaccttcccccatagattcatcctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcacagac

SEQ ID NO: 11330 - DNA, 747 bp, Homo sapiens
  ENST00000458253
gcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgctaaattgcagagggtcccagtttcattcattctccctcacagggaaggcattctcttcctcttcctccagctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcac

SEQ ID NO: 11331 - DNA, 722 bp, Homo sapiens
  ENST00000454729
ggagagctgggcttcgaggcgtcagtgtgaagggaaggctaaggacgcatcggtgctggagagttgagaatatgccttcccctccacccccaacccagtcaccttatttgaaaaaaaattaaaaaacaccttttatttaaaaacctaaccctggaagtttgctcgggaaggcattctcttcctcttcctccagctgcctgaaaatcatatgcgtggtttttcctgtttcctgctctgtagctgacatcaggggagcaacgtgaacacaggaaaatggaaatcaacatttgaaacttttaaatggaagctttattggggttccacatatggaaaactgcaaatagcagaagtatgtgactcaataaattattctggagtgaccacatcctctaactgcctcccaggacaagacggagaatgtgaacaatgctcctgaaggcccctttccctcaaagaatcactgcaattgaaggaaaaatgctccatgtcccctctgccagttggtgtttatcaaaggacaacggaggaagagagacaaagtgcctggatgtgtgtgttaatcaagagttgtcaggaccctgcctctaaaagaaagcgctaaaatgatgcttttgacaagacttttctcaaagtggatgcagtctaagggttggaaaacaaggcccaatcaggctaggtctgacttgtcgcctgcttttgtaaataaagttttattggctcac

SEQ ID NO: 11332 - DNA, 827 bp, Homo sapiens
  ENST00000434969
agaaaagctggaatgccgttaaaacaacaccctgtcatctttcaatcagtccttagctgaagttaaaatcccactcattctgcatgatccagcctctgtagcatagagtgagtagccccttaacaagaaccaaaatggagggtacggatgaggctcagatcgtcaccacctggagaatagagacagtgactgagtcaccaggaaatctgtcccctgctcatcccagaatccccgagctttgactttttaagagaacatgtgacagataatgccatctgagaaggattgcctcctttactgtatgttttccactgagatgaagattttggtcatttcctcattcatgttcctgcttttcaaaacccaagcaagaaaggaaacttctacagtgactttctcattatgaaatcttagcattcactagtcggccataatggaaaaccagccaaatggacacatatacactggtctgtacccgcagagaaagaaatgcaaatctctgtgatcagaaaactatcctatcttgtacattgttaaaagtctgcctccaaaaagtttacttctggaatactgtaattgaatagaatcagggatcctacctgtgtccttcaactttcacatcttgtctactcaagtaagggttgaatttgcatgactatatctaaggttcgagggcttacctgttggcagtagacccagtagtctatgaatggaaatgggcaaacctgtgacctcccaaaactttaatatgaaagttttgtttgtgtatactcatggcattattcttttaataaagagataatctatatagttttcttttttaaaag

SEQ ID NO: 11333 - DNA, 326 bp, Homo sapiens
  ENST00000421034
tggagaatagagacagtgactgagtcaccaggaaatctgtcccctgctcatcccagaatccccgagctttgactttttaagagaacatgtgacagataatgccatctgagaagcttaggcaactcagtcatcaatgtgtcctcgagaagagcatatccccaaattggaaaataatccttcagggcatctgaacataaccacatttggcttactttgtgaagcagttgtctgaatagaataagactggcttggaacgagattcacagagcaaccaaataaagatgattgagtgaatggctaaagaaataaatatgttcgaatctgta

SEQ ID NO: 11334 - DNA, 1339 bp, Homo sapiens
  ENST00000433152
acataggtccccagagaatttcaatatgtctgatgtcaagaacggaaagtgagacagccaggtgggagggggtccctggagaatctccaaccagcctgcgcactgggaatgcgcactggagtgaaaatacagaagttggtgccctttgcagcagccaggagtccgactcctcctcttcctgtgtggaacctggaattcaaacggctggggcctcactcacggcatatggaactaaccacgcccctaactaagaaggcacaccttagttgcagttagcacacaattaaagcaactctccaagttttaccttaaagttcaaaattgctaggagttgaaactactagaaatatatttacatgcaagagtcaaagaaactttgaactatttatggcctttaataattaagtaaggtatactcctgtgatcaagacttggagcatatttgtttctctctgcctggttcctctagaaattggaaactatcagaacagagaccaactccgtttcccgatccctttgcaatctgcattgaaccatgagtcaagttcttgataaaggagtgaaaatggatgacatttaaggcacatctgaagatggggaaaccacagcacagaataaggctgggcccttgaatcaataaatgaaggagaactactcaagagaacaaaaccaccagcaatatccacctgtatttgtcttttcataatgtgtgacacatgtgctcatggattattgtccgaagcaagacatgtgaccaagcctaacatcaactgggtgaagagctatatgttcctttctcaagaggcactacaagtgacatgccactgggcagatggagtctcgctctgtcacccaggctagagtgcagtaccgcaatctcggctcgctgcaagctctgactcccaggttcacaccattctcctgcctcagcctcccaagtagctggcactacaggcgcccaccaccatgcctggctaattttttatatttttagtagagaaggggtttcgccgtgttagccagaatggtcttgatctcctgacctcatgatctgcccacctcggcctcccaaagtgctgggattacaggcgtgagccaccgcgactggcctaacatatttttaaaacctgcagaatgtttgtattacttttgtcatagtacataacatttaaatggatttcttgtttgtgtatgtgtgtatattcattcacaacactgatagtttttctgaatatttcctttggattttattcttttctcattcaactaaataagaacctgcaccatctttttctagtgtaaaaattacaatatctgaagtgaaactactagaataaat

SEQ ID NO: 11335 - DNA, 559 bp, Homo sapiens
  ENST00000601979
actggagtgaaaatacagaagttggtgccctttgcagcagccaggagtccgactcctcctcttcctgtgtggaacctggaattcaaacggctggagtcaaagaaactttgaactatttatggcctttaataattaagtaaggtatactcctgtgatcaagacttggagcatatttgtttctctctgcctggttcctctagaaattggaaactatcagaacagagaccaactccgtttcccgatccctttgcaatctgcattgaaccatgagtcaagttcttgataaaggagtgaaaatggatgacatttaaggcacatctgaagatggggaaaccacagcacagaataaggctgggcccttgaatcaataaatgaaggagaactactcaagagaacaaaaccaccagcaatatccacctgtatttgtcttttcataatgtgtgacacatgtgctcatggattattgtccgaagcaagacatgtgaccaagcctaacatcaactgggtgaagagctatatgttcctttctcaagaggcactacaagtgacatgccactgg

SEQ ID NO: 11336 - DNA, 755 bp, Homo sapiens
  ENST00000599409
gactcctcctcttcctgtgtggaacctggaattcaaacggctgggtaggaagcacgctagcaggggcctctggccttgctgagggtccctgtttccccttttccttccttttcacccaacaaaaccctgctttactcacccttcaaaccatctatgagcctaaattgtcgtggtcgtggaatggacaaggacccagtctttagctgaactaagggaaagtcctgctttttggcgcgcaacaggggagctcaagaaacaggcctcactcacggcatatggaactaaccacgcccctaactaagaaggcacaccttagttgcagttagcacacaattaaagcaactctccaagttttaccttaaagttcaaaattgctaggagttgaaactactagaaatatatttacatgcaagagtcaaagaaactttgaactatttatggcctttaataattaagtaaggtatactcctgtgatcaagacttggagcatatttgtttctctctgcctggttcctctagaaattggaaactatcagaacagagaccaactccgtttcccgatccctttgcaatctgcattgaaccatgagtcaagttcttgataaaggagtgaaaatggatgacatttaaggcacatctgaagatggggaaaccacagcacagaataaggctgggcccttgaatcaataaatgaaggagaactactcaagagaacaaaaccaccagcaatatccacctgtatttgtcttttcata

SEQ ID NO: 11337 - DNA, 694 bp, Homo sapiens
  ENST00000620859
ttcctgtgtggaacctggaattcaaacggctggggcctcactcacggcatatggaactaaccacgcccctaactaagaaggcacaccttagttgcagttagcacacaattaaagcaactctccaagttttaccttaaagttcaaaattgctaggagttgaaactactagaaatatatttacatgcaagagtcaaagaaactttgaactatttatggcctttaataattaagtaaggtatactcctgtgatcaagacttggagcatatttgtttctctctgcctggttcctctagaaattggaaactatcagggagagatgatgacagcctgaacaaggatgacaataatggaaacagagacaaaaggacagaggtggaacagagaccaactccgtttcccgatccctttgcaatctgcattgaaccatgagtcaagttcttgataaaggagtgaaaatggtaagtctaaagcaatgaaaagctgctgtattgactacacatgccttcatttcttctaccctgcttctttcatgcctgcttatctgaatgacaccaggatgacatttaaggcacatctgaagatggggaaaccacagcacagaataaggctgggcccttgaatcaataaatgaaggagaactactcaagagaacaaaaccaccagcaatatccacctgtatttgtcttttcataa

SEQ ID NO: 11338 - DNA, 854 bp, Homo sapiens
  ENST00000608678
aaacggctgggtaggaagcacgctagcaggggcctctggccttgctgagggtccctgtttccccttttccttccttttcacccaacaaaaccctgctttactcacccttcaaaccatctatgagcctaaattgtcgtggtcgtggaatggacaaggacccagtctttagctgaactaagggaaagtcctgctttttggcgcgcaacaggggagctcaagaaacaggcctcactcacggcatatggaactaaccacgcccctaactaagaaggcacaccttagttgcagttagcacacaattaaagcaactctccaagttttaccttaaagttcaaaattgctaggagttgaaactactagaaatatatttacatgcaagagtcaaagaaactttgaactatttatggcctttaataattaagtaaggtatactcctgtgatcaagacttggagcatatttgtttctctctgcctggttcctctagaaattggaaactatcattgtcagcataacctcattcttcttggacacgggacaagaattcaggatgcaccaaatgcaggaacagagaccaactccgtttcccgatccctttgcaatctgcattgaaccatgagtcaagttcttgataaaggagtgaaaatggtaagtctaaagcaatgaaaagctgctgtattgactacacatgccttcatttcttctaccctgcttctttcatgcctgcttatctgaatgacaccaggatgacatttaaggcacatctgaagatggggaaaccacagcacagaataaggctgggcccttgaatcaataaatgaaggagaactactcaagagaacaaaaccaccagcaa

SEQ ID NO: 11339 - DNA, 1032 bp, Homo sapiens
  ENST00000593568
cgggggaaaggccttttccttcctttttcaggacagacaggaaagccggggctcctcactccccctcccctctgtgcccgggacgggatgcatggcccaagggtcccacacagctggctagatggttctcagacacaagccaccgcagccttccttttcccctgccagggggttaaactttatcagagagtaattaagctttaaccctgctgttgaaatcacttgcagacgaataagaagttcttccccaggcatttttaaaccttttttcactccccttttccacctcctcaacaagtaaacccttaaagttttttttttgtttgtttgtttgtttttttttagaagacactttactaggccactccctctgctccccagctatcactgtatgctctgcaaagttttgcttgtgaaataaatcctctattttgttttacatcctgaggccatggcttataactctggcggcaaggatttgtttagcaatcctgccttaggggatgagccctctctaattcaatatctgcatgtcccctgtctcttaaagggcctcactcacggcatatggaactaaccacgcccctaactaagaaggcacaccttagttgcagttagcacacaattaaagcaactctccaagttttaccttaaagttcaaaattgctaggagttgaaactactagaaatatatttacatgcaagagtcaaagaaactttgaactatttatggcctttaataattaagtaaggtatactcctgtgatcaagacttggagcatatttgtttctctctgcctggttcctctagaaattggaaactatcagaacagagaccaactccgtttcccgatccctttgcaatctgcattgaaccatgagtcaagttcttgataaaggagtgaaaatgtgtgtgacacatgtgctcatggattattgtccgaagcaagacatgtgaccaagcctaacatcaactgggtgaagagctatatgttcctttctcaagaggcactacaagtgacatgccactgg

SEQ ID NO: 11340 - DNA, 402 bp, Homo sapiens
  ENST00000595269
tgtgtgacacatgtgctcatggattattgtccgaagcaagacatgtgaccaagcctaacatcaactgggtgaagagctatatgttcctttctcaagaggcactacaagtgacatgccactgggcagtttagcaaaagctggaggtgccttgacatttgcagtacactgaaacagtggctggcttgaaaaatcccaaaacgattttctgcaggagagcccttttgactaatatgagggcagtgaaaagactccatttatgaaacaggaaatgagccctcatcagacactgaatctgccggcacattgatcttcgacttctgccttcagaaccatgaaagggtgaggcaatgaaaagccaatctgtaattgtctgctctttcttaccctgctgctaactactga

SEQ ID NO: 11341 - DNA, 496 bp, Homo sapiens
  ENST00000598092
agcctaacatcaactgggtgaagagctatatgttcctttctcaagaggcactacaagtgacatgccactgggcagggggcaggtctttcctgtgctgttcttgtgaaagtgagtaagtctcatgagatctgaaggctttgaaaaacaggaatctccctgtacaagctctctctttgcctgctgccatccatgtaagacgtgacttgctccttcttgtcttctgccataattgtgagtcttccccagccatgtggaactgtcttggttggagtccaggtatctgcaaattaaataagcacttgaagtgatagtatctgagtgtccgtaggcaaatgttaggagaactgaatcagatgttctttgaaagattttcatggttctaaaatgttctgatttaaaatccacaaagaaaaaaagcattgaaaatgaatcagcaaactagatgtaattaaagcttcttgcaattccattaataaactttttagaatgaattaca

SEQ ID NO: 11342 - DNA, 632 bp, Homo sapiens
  ENST00000618687
ctcaagaggcactacaagtgacatgccactgggcagtttagcaaaagctggaggtgccttgacatttgcagtacactgaaacagtggctggcttgaaaaatcccaaaacgattttctgcaggagagcccttttgactaatatgaggtacaaagaaaaagaagtctacaacagatgtgctgaagctcagaaaatggcactacaaagtgtggcactttgacatgctaagtactttgaactaaagaagcagcctcaaaacgaagatctttctgaacttgtcttaccaccccgtctctctaccctgtttctcccctaaaactctcagagaggctttctgtgaactttcccttatctgactaagggaagttcctccagaagcaatgcaattgttatgaaccccttccctggaatccacattaaccagagaagattatctcatgtagcaagagaggagactaaaggtctttctgtccaggataccatatctacagaggctttacatccatttttctgagagttcatcagaccatgtctgtgcaaaaaccgggacaattccagtgtacactaggaaaaagttattcagcttatttcagctttgcaagaaacttctcatcaaagaaacacacaggcttct

SEQ ID NO: 11343 - DNA, 920 bp, Homo sapiens
  ENST00000601389
ggcactacaagtgacatgccactgggcagcctctcaactcaggagatacagtgtggaagatcttattgaaaccacctttgcaaaaattataactgagaaaactatgacaatgaaagagatctacctgattccatcttgcttctaacctctacgctctcctaatttatacctgggtttaggcagaactattttttggaggaacttagtttatagtttaactttggaacaaagatgatcacagcctcatcccaaaacaaactcccttcctgcctggaggctagattgcctttgtgggactaacaaattagctacaagattagagattatgatttaggagtcatgcatctggaggctacaagatgctgaacctccccaaattgcttctggggataacattacttttgtaaaacctgagatcagtgcttgagatattttacagacactgtacttgatggcttatttggtcttgtggcccccacccaggaattgactcagtgcaagaggacagctgggactcccaatgatttcatctctcaccgcaccagtcagcactccccactgtccaacccctgccaccaaattatccttgaaaacctcgatccccaggttttcagggagactgatttacgtaataataaagctctggtctcctgcacagctggctctgtatgaattaaactctttattacaattcccctgtcttgataaatcggctctgtctaggcagagggcaaggaagaccccttgggcagttacattatctcttttcttcttagaacataagtctttctccattgtattgaaaggtcattaagagtctgttcaaataactcatatgtgaaatatgacaagaattccatactaatataatgttatccagtaatatttacagcaaagttactatttatgcagtgttttgc

SEQ ID NO: 11344 - DNA, 778 bp, Homo sapiens
  ENST00000598902
ggcactacaagtgacatgccactgggcaggattatcctttctactctcctactttctgaactacttttctccctctgtaagtcttaaagaagttcaatgagctataagtgaactcaggtagacaactcaacaaaatcaagaagacaatacatgaacaaaatgatactttgaataaataaatataaaccataaaaaacttgaattattcagttcagtcataatacatgactttaaacttcaaaacagtttgttatagtacagccaaaatcattaaaattggtcagctaagaagtatatattttttctagttctctaatggatagctgtacattatattcacaacttacaaaatctgtccagcaagataacagattagaagacacttaacattgcttcccccacaaaggtataagcagtaactattcaaagacaataaaactaccctgaagttactagaacttgagagagaagcagaggaactgatggagcctgcagaaatgagagaagctgtgactgataaatgacgattttagaatctgccacccactaccccaagccacataacagctcacagaaaatttctatacatttaggatgtctgagttggaagaaattcgaagttgaaaataaacattcaatttccctatcagttgaggaggcttcatgggaagtctacatgggtctcatcccatggaaaacactgagagttccaggagggctgaatgacctgagtgaactgaagataaaatcaggagagctgattgcagcaactgtcctg

SEQ ID NO: 11345 - DNA, 573 bp, Homo sapiens
  ENST00000595737
ggcactacaagtgacatgccactgggcagcactgttcacattatgtaagtgataaaattgacctaaatatccatcaatggacaaatagatcaagaaaacatgataaacatacacagtggaatactatacagctacaaaaagaatgaccttctgtcatttgtgacaacgtggataaacctgcaggacattctgttaagtgaaatcaaccaggtacagaaaaacaaatattgcatgagctcactcatatgtggaatctaaagtaattttactcattgaccaacctctttccatcccccatccccttttctctcctcaacctctggtaactgctgttctactctttatttctatgagaccacagttacagttagataggaagaataaattctggtgttctattacatagcagagtgactacagctaaaaatagtgtattatatatttcaatatagctagagaagaagatcttgaatgttatcaccacaaagaaatgataatgctgtggtaatgggtatgttaattatcctgatatgatcattaaacaatgcatatatctattgaaacatcacagta

SEQ ID NO: 11346 - DNA, 757 bp, Homo sapiens
  ENST00000601926
ggcactacaagtgacatgccactgggcagtggctgctatggaaacaagtcctgatgcatgacagaggaggaaagctatcagtcctgtggttaaagaggggacatttccactagatttccaattgcatatggaatcaagaaagaagcaactgggaattacttcacacagcaaatctaaggaagagactgttaatttggctttgccagttactccttctcaaggcccataattaaatgtgagtttctgggcactaatgcaaaagccagatttgctctgagcctgcggggcttataaattggttgcttttgcaaactgttattgttcctttaggtcaagaggggaagaattattgactttgttcagttgaattaaatgctccccttgtggtttgaaagaagaaatttgcctccctcaccctctaagattacatacaaagggagaattgtttttgggcaagttagacttgatgaaaaaatatacagttctactggattatagcactgtgtgttgccttagagtcacatgactccagttttgccttctatatgaagcccaaggctttcatctttttctgatacagtgggctcttcagctttaagcactgacttttgtgtgctagtatacaatgcctgtacactcccacaaaaagctcaagatgtccttacacgtatttgctgtaggtgtccttcagccgatttcagtgcctagaatctagatgctttgcacctagtttcacctttgctcacagatgctagtg

SEQ ID NO: 11347 - DNA, 781 bp, Homo sapiens
  ENST00000601888
ggcactacaagtgacatgccactgggcaggatttttatttcatttgcaatgaatgaagaagcacagctctgaaagactgaattcccagcactgggtgtcagctctaccaaatgcggtacagattgcaatctgaccacagaatctcaccacaaagaatgccggggtctcctctgattatagctactggctataagttctaactagggtttaatgcaaattttccctgtagtctgcttggggagttggcctcattcttgaatttttctcagaaagttattgccaaaaatgtgagttctcaccgcagtgaaagaggaaatccagctatgagcatatataatacaggagaaagaatgcagagaaaacacattcttttcttgctactcagttgccagagaagtatatctataatattttcagttgtgatgctatgtcccattgaattcaaccacacattggaaaaatcagtttaccctagaatctagttattgttgtggtacagtttaatttttgtcaaataattctttctaaaatttctaatgtaagtctttaattttcaagatattttgcttagaagatgatatggtttggctgtgtccccacccaaatctcaccttgaattcccaggtgttgtagggggcaggtctttcctgtgctgttcttgtgaaagtgagtaagtctcatgagatctgaaggctttgaaaaacaggaatctccctgtacaagctctctctttgcctgctgccatccatgtaagacgtgacttgctccttcttgtcttctg

SEQ ID NO: 11348 - DNA, 559 bp, Homo sapiens
  ENST00000629716
ggcactacaagtgacatgccactgggcagtttagcaaaagctggaggtgccttgacatttgcagtacactgaaacagtggctggcttgaaaaatcccaaaacgattttctgcaggagagcccttttgactaatatgagagtctcgctctgtcatccaggctggaatgcagtggcacgatctcggctcattgcaacctctgcttcccgggttcaagtgattctcatgcctcagcctcctgagtacccggaactacaggcacctgccaccacacctggctaatttttgtatttttagtagacctggggttttgccttattggccaggctggtcttgaactcttgaccttgtgatccacccatcttggcctcccaaagtgctgggattacaggtgtgggccaccgtgactggccaacattatgtattttaaaagatgtcttcaaatagaaacacacataaaataaggccatttatgaatcagttgaaaataaatataaaatctggttatatgaaaatataaccagagctctcagggccctaaccctgtgtttcccttaggaa

SEQ ID NO: 11349 - DNA, 267 bp, Homo sapiens
  ENST00000626101
ggcactacaagtgacatgccactgggcagtttagcaaaagctggaggtgccttgacatttgcagtacactgaaacagtggctggcttgaaaaatcccaaaacgattttctgcaggagagcccttttgactaatatgagatggcagagcctccatcaagccaggtggactgagtagcgcaaactctctctttacccgtgttggacaggtaagatgtgcctgcttccccttctgccatgattgtaagtttcctgaagcttccccagaca

SEQ ID NO: 11350 - DNA, 581 bp, Homo sapiens
  ENST00000626907
ggcactacaagtgacatgccactgggcagtttagcaaaagctggaggtgccttgacatttgcagtacactgaaacagtggctggcttgaaaaatcccaaaacgattttctgcaggagagcccttttgactaatatgaggtaagatgtgcctgcttccccttctgccatgattgtaagtttcctgaagcttccccagacatgtggaactgtgagtcaattaagtctcttttctttataaatttctcagtctcagatatttctttacagcagtgtgaaaacaggctaacacaagcagttattttgctaccatctactgaatcttataacgtattatatgaaaacacagggaattgaagtgatgcaggaaatactggaaatctgcctgcctgctgctacttctctctgtagcattggaaaaacaagttaacttctttgcttccatttcatcctccacttacgtgacaggaagaagattacctgctatttctaaagaactttgaagctaaaagctagtgtgtaaccagaaaaagtgctttaattagatttcaaatgattcaagcatagtccagtgtaaaacaact

SEQ ID NO: 11351 - DNA, 456 bp, Homo sapiens
  ENST00000596743
gcactacaagtgacatgccactgggcaggtaagatcctctcaaatgaagggactgtgaatatttgactaataatacaaatatttactggatattttacagtgatatttacaaatatcactggctaacttttcccagcttgatatcctgaaagaggcacagtttcagtagtaaatggtaaatttaccttgattgcactgaaggctatttctttaaaactattttctttccttttgactattccatgtatcctttcagaagtaaacattgtttttacccctttaaaaagtctacttataccatctacttaatttggaatttatctaacattgccagtttgatatagatacagaaatttaatgagaaaatgcagttctatatttagaatatggattcttcaagatgtttctgacacacatttgttttcattgaaacattaaacaattatttagctaaca

SEQ ID NO: 11352 - DNA, 1068 bp, Homo sapiens
  ENST00000594054
ctacaagtgacatgccactgggcagaaaataaattggaatgaagcccatgtgaatgcatggagacaaggtgaaaaggtagatgagaaaaaagttggaaatatttgcaggtacatttgacaggaccaggagatgtcttgggcattcatgatgatggaagagtggtcaataatgactctattttctagcttgtatcatgagatgaatggagacccgtagaagaataagttttgtgagtgactgggtcatgtaatatattttggatttgttaaatgtgaactacttttaagaaactgtggggaaaaacttcgttttgtttacatccatgaatcatttgaagcacgaaaaataattctcagctgaagatacaaatatgagggccctgggtgtataactgaaggcacgagtataaatgggattatttagggagggcttaaaagtggatagagagtaaattcacagactataggtacaaaataatcaccaatgacaatatattatgcagcttaagaccaattgtatgtattttcctgacaatgtcttttagagcctgtgactagttttctcctgaagatgtggtgatcttcttatcaatttttaagagtacttaaatgttttaacaattatatttaactcaaaattagtttccaacttgttttcctttaattataatttaaagtgtatattttatgtgtacgaatattaaaaatttatgaagtcatatctattgcctttgtctcttattactttaccaatgcttacaaaaactttcctcattaatgcttatataaatcttcttttttattgcaaatttttccattcttctggtttgtaaaatgcctaaagtaaaatgtgtatctgaattaattaatcgttaaatatcttttcaattttctcaacccaatatattggacaattcacctcttactcccagagttttatctctacatattattcctatgaagcttttacacatgctgagactaaatggtctgttctatgtcattgattctatttgcctagttgtctatttaccttgtagttttgaggtaataaatggtcctttaaac

SEQ ID NO: 11353 - DNA, 748 bp, Homo sapiens
  ENST00000600848
ctacaagtgacatgccactgggcagtttagcaaaagctggaggtgccttgacatttgcagtacactgaaacagtggctggcttgaaaaatcccaaaacgattttctgcaggagagcccttttgactaatatgagaatatttatgtgtgaatcaactagaggaatgaacatcacctaaagacaaaacaggatctttgtatacatcttctgggaaggagttgttatcatttccacaaggccaattgcatcattcggataaaaacattatattgttgtctttatttggaagtaaaatatattttaaagagatgtgaatgattataaagtttataataggtatactgtgatgactttgtcaaacgttaacttgactaggctgaatgatatttcctagaattccctttcctttgttttctattaaagagggaatgttttctggtagaccatgtaatagagatagaagttcttcttttttacgcattcattcattattatagtttaatgaatcataaatgaaaaaaaaaccctcttccagaagcatttactaacactttcaggtatatgagaatggaataattttcagaaactgggctttctgtattttccctgttggctatttcagaccagttcccgacccttctccatccttctccatgccctgggaaaccgacttttatagactgcaaaagtatgctctcttacactttggtttcttattgaggtcaaataataaaaatcactgccaaaaa

SEQ ID NO: 11354 - DNA, 1339 bp, Homo sapiens; identical to SEQ ID NO: 11334
  ENST00000634651

SEQ ID NO: 11355 - DNA, 559 bp, Homo sapiens; identical to SEQ ID NO: 11335
  ENST00000634872

SEQ ID NO: 11356 - DNA, 755 bp, Homo sapiens; identical to SEQ ID NO: 11336
  ENST00000635412

SEQ ID NO: 11357 - DNA, 694 bp, Homo sapiens; identical to SEQ ID NO: 11337
  ENST00000635635

SEQ ID NO: 11358 - DNA, 854 bp, Homo sapiens; identical to SEQ ID NO: 11338
  ENST00000634807

SEQ ID NO: 11359 - DNA, 1032 bp, Homo sapiens; identical to SEQ ID NO: 11339
  ENST00000634663

SEQ ID NO: 11360 - DNA, 402 bp, Homo sapiens; identical to SEQ ID NO: 11340
  ENST00000634943

SEQ ID NO: 11361 - DNA, 496 bp, Homo sapiens; identical to SEQ ID NO: 11341
  ENST00000635203

SEQ ID NO: 11362 - DNA, 632 bp, Homo sapiens; identical to SEQ ID NO: 11342
  ENST00000634292

SEQ ID NO: 11363 - DNA, 920 bp, Homo sapiens; identical to SEQ ID NO: 11343
  ENST00000634289

SEQ ID NO: 11364 - DNA, 778 bp, Homo sapiens; identical to SEQ ID NO: 11344
  ENST00000635024

SEQ ID NO: 11365 - DNA, 573 bp, Homo sapiens; identical to SEQ ID NO: 11345
  ENST00000634792

SEQ ID NO: 11366 - DNA, 757 bp, Homo sapiens; identical to SEQ ID NO: 11346
  ENST00000634691

SEQ ID NO: 11367 - DNA, 781 bp, Homo sapiens; identical to SEQ ID NO: 11347
  ENST00000635204

SEQ ID NO: 11368 - DNA, 559 bp, Homo sapiens; identical to SEQ ID NO: 11348
  ENST00000635232

SEQ ID NO: 11369 - DNA, 267 bp, Homo sapiens; identical to SEQ ID NO: 11349
  ENST00000634685

SEQ ID NO: 11370 - DNA, 581 bp, Homo sapiens; identical to SEQ ID NO: 11350
  ENST00000634668

SEQ ID NO: 11371 - DNA, 456 bp, Homo sapiens; identical to SEQ ID NO: 11351
  ENST00000634507

SEQ ID NO: 11372 - DNA, 1068 bp, Homo sapiens; identical to SEQ ID NO: 11352
  ENST00000635143

SEQ ID NO: 11373 - DNA, 748 bp, Homo sapiens; identical to SEQ ID NO: 11353
  ENST00000635709

SEQ ID NO: 11374 - DNA, 5168 bp, Homo sapiens
  ENST00000567801
attctctaggcgaaggagaacaataagaggcaggtaaagctggagcccgtaacaggaggaaacgtgagcattgaaaacccgccctttggatgaactgaccacagctggacaacaccagtgccaggccagggttccaagcactgcagagatgaagcaccttcttccaggagttcctggagttctcagaagccagagtggacttgttcctccgttttatttgatgaggttctaaatatagctgggcaaggcttcggattttagtgggagatggccagaggcgaagcaactgataaaagtagctgaatagctctccctctctgagctaggtgcaagctcctgacgtaggaagcgatccctccttgccacagataacccacgtagccaggtgctgccaagcagcttccacctggaggagggcagctgctctgcgcatgaccagtagctgtggatggcatcgtcgaggcatctggaggaagctgcagccccacaaggcccctgacccctctgcctttccctctgctggctcctcttcctccctctttccctgctgtcccctgtagagaactttctaccagtccacacaccaacctaggtgcagcccccctgcgtgactccctccctgactatcataaccatggccagcagtatctccacatctctgcccagatccccctgggaaggcttatcccaggccccaggtttggggcaatgcccagtggcatcggatggggtcccccttgaaaggaagcacagaaagactgagccatcaacgtagtcccctccatcacctgccactgtccccaaaatctcccacaccggaagtgtttagattgtctaaggacaatattgtctagggtttgaggaccaccccacagcaaaaacactagaaagctagttccaaaatgcaaatcccaggccaagcccctcacctcctgaggcagcatccctgggtatagatctcagaaatctgcagttttaatacaaaggccccctaaacttaaagaaacagcctgaattcacatgggcacaccttacctgagcaggcaatacagtgacaagggtggaaacagaggggacgagacctgacactgggaaggcctgacagagggaaggaaggaaagctctcaggctaagggcgctgggaaccccactcttccctctagggagttgccgttccctgaggggcctgaggagcctcctcctgaagccccagctattcaaattacaccttttcttattaggacatcaggaggtgttgccccttagctttccattctaacctcctcaatgtaggggccttgctggtgtcgaggacagagcggaggcctcaagggtatgtgcagtctaggtggccttggtggaggggcaggattctacatttgggaggggacttcttgctgaactccttccagatgggtcaaatggggtagactgagggagtggtgtgggaggtggtaaagaaccaagtagggactggatggatcctgggagtttacagggctgcctcggagagggagggtgctgagagagaggagaccagggtgggcaccaacgcgatccctgcaggctatgagtgtaggatcagagagggttaagggccagaagcccctgtgtgtttaggactgtggcaccatgggtgcatcccctgagaagcgaagctcaggcaggagcagcagtgggcaaagagcctggtggtgcaggtgcaggccctgtagaggaggcagtgacaacacccagcccaggccgactctctctgcctgtcccctgagtcccctggcacctctccacatctgctcagccctcccagttaacctagcactggtagatggttgatatgatttggatctgtgtccccaaatctcatgttgaattctaatccccagtgttggaggtggggcctggtgggaggtgattggatcatgggggtgaatccttcatgaatggcttagctttatccccttaatgctgttcttgtggtagtgagggaattcttgcaatatctggttgtttaaaagtgtgtagcacttcccccccaacactcttttgttcctgttccaactgtgtgaagtgctcactccccctttgccttctgctatgactgttaagtttcctgaggccttcccagaagctgagcaggtgtcagcatcatgctttctgtatagcctgaggaaccataagccaattaaacctcttttctttaaaaattacccagtctgagatatttcttttcttttctttgagacagggtctggctctgtcacccaggctggagcgtagctgcacctctgcctccagggctcaagtgatcctcccacctcagcctcacaagtcactgggaccacagcacgtgccaccacacccagctaatgtttgctttctttgtagagacagggtttcaccatgttgcacaggctggtctcaaactcctgagctcatgcgattctcctgtcttggcctcccaaagtgatgggattacaggtttgagccactgcactcatcctaggtatttctctatagcaatgcaagaaaaactaatacgaaggtgaatccatctgcagatccagactccacaggaagccagcaagtgtgattgcgggctctgctgcatttcaggggcggttctatacttggcacgtgcatgctttccccagcctagcatattagcctgctggggctactataacaaaataccacaaactgagtggcttaatacaactgaaatgcattctctcacacttctagtggccaaagtccaagatcaaagttttggcagggttggctccttctggacactcagagggagagtctgtcctgtgtctctcccctggcttctcctggttgctggcaacccttggcattttttgcttataaatgcatccctcttatctcagcctgtactgtcacgtgaccttcttccctgtgcatctgtctcttgtcctcttcttctaaggacagcagtcatattggattaagggcccagccactccagcatgacctcctcttaacttgatggcattcaaagccatcaggtttggaaacaaggtcacattaccagggaccggaggctaggacttgaagataccctttgggaggagacacctgcaacgtttggattggagaagactcagtgaccttctgggatgtcgtttaccctccctgggctgcagcttccttgtttgtagaggaagaggttaaattaaacaatctcttccaggtctcatggtcttcgaatctgttttctcctctgctgttttctcagcttccttctcccgatggaaatagggggccagtgtatttcccctgcctcccctccctctcagccctgctttcaagtcttagagctggcaagggctttgtgcaatactccaggtcctaccctcaatttctggtggaacaacagaataagcggtctctgcatgcacacaaatcccttcagctccgtctgggcccagcggcagctgaccaaccagcccatcacacacctttctgcaggccccttccccgcccggcctctttctctactctttttgtttatttttattccccagtctctcatctctcacctatacagtcaagtttccagcctctctttccacccactgttcagccatcagtcagcctaaacattctactttctgcctttctccccacaagcaactttgtttgcagagaacccacagagtttgacatgttgtctgcagactctctgtccacaggctgcaggtgtagtggagcccgctccagactgagacagaggcccaggtttttaccaggctgtgctgctgccagcctggtgtgactacccatcccacccccttcgatacctgtgcctcagtttctcccatggataatggagtgggactcaatgggagtaacagactccaagaacatgaatgggggtgagcagggaccaccaaacacgtcctctgcccatctcatgtccgacccactcacctcccaagtaacaggcacaacttcaccaaatctgtggccccccaactgggtggataaggccaggacttgcttctgatttgcacagcacatccccccagcattggaataaaagctgctcaggatggccctcgagataaggttttcagagctctagggatccagacccaaaactgcgggacctctgaggaagcacaggttcctgcactgaaggcagagcactggccatctattttgactctaaatatttggaggaattctgcgagctgttttgtaagctgcactgaggtaatgctgtgtcatggaaaccagtgcaggcaagatttctagggagaggcagtgtttacccttgttacatggactagaggtcagcaaaagcagaagcccctcaagagcgtgcgcagagctgcagaggtaagctggcaggtcccaaccagtctccagcaaatttggccatgaaatgaggaatccctgggacctccgtttttcttggccatgtcccttgctgggcacctatatgcgtgatcttatttcagcttcatgattcttgcaggcatcattatcaatgtttttgttgctgttttaactggcggggtgggcggggagagaggggaaatcacgttcccagagacatatagctaaagagaaagtgaagatttgagcctgacaccagccatgcttttcctgacattcctggcagtgtgaaaggaaggacagcaatatggttttcttgaaggggtaacaagtttcagcaaataattttgcttatatcttacgagagaggcatggatgtttgctgggagggaaaggagctagtagcaagtggaagaggaaagactccaaaaccaagaggagggctcttctctcccagagttgaggggggaaggatgggagggaggtaaaggtcagaaatctctctttatttggaatggtttgcacagcggctcacaatcggagcttccctctgcctcagacaggcctcttctctaacaggtgtaatgcagtgatgttttcctttggcttccttgctgagtcatgactagatttgcctgggaaagctcagatattactgattcagtgttcattcctttttcctccttaccaccagccttcaacactccatatgacgccttcaataggaagggaggaagataaataacatggaaacagagagaatcacctggaccaattttggtattaaaaaacctggaaaaagc

SEQ ID NO: 11375 - DNA, 3055 bp, Homo sapiens
  ENST00000355300
gcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtg

SEQ ID NO: 11376 - DNA, 2677 bp, Homo sapiens
  ENST00000561030
agaggataattccccattatacagagatatttagcctaatagaagccgacagatcattcagggcagtaatgtactccggcttcaagcgtgtagtttcctcagcctgaactcccagattaaaggctccttgcccagcccgccctgtgccggtgcctgtgaccttgactgcaatgatgggggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaacta

SEQ ID NO: 11377 - DNA, 1035 bp, Homo sapiens
  ENST00000557798
tccagacaggactgtccagagcaacggtgtgccagagagactgagaagtacccagaaatggtgcagctggaacagaaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcggg

SEQ ID NO: 11378 - DNA, 938 bp, Homo sapiens
  ENST00000561686
ggctcagcctcaggtcctgcggggctgaccagtgtgcagagtgccctgaaagtgccaggcctggctgggtgcttcccatcttcacagcagctgagaggcagctaccaccacccttcttatagaagaggaagcagaggctttgtgaagtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcagggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccg

SEQ ID NO: 11379 - DNA, 588 bp, Homo sapiens
  ENST00000567726
gattttaagctccatctcttgctggcggtgccaccttgggcaagccatgtggccattctgagctgttttctcatctgcagaatggttgggatcatttgtgcttcaagagtcatgtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctga

SEQ ID NO: 11380 - DNA, 611 bp, Homo sapiens
  ENST00000566711
gcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacgcctccggcacccacaggccctgaggctccagtgcccacaggcagagagggcgactgagtccagcccaggctgagccctgcccagctgtactccccagacacccacccaacccgagtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggaccta

SEQ ID NO: 11381 - DNA, 552 bp, Homo sapiens
  ENST00000559893
attattagctccatctaagagacaggaagacggagattccaagaggctcagggacttgcccggggtcacctggctgaccagtggccttgtcaggcctccacccagggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctt

SEQ ID NO: 11382 - DNA, 522 bp, Homo sapiens
  ENST00000564472
actctgagatctaacccaaggaggagcgggtgcccgagaggggaagggagctcaagaaaaaaaaaaatagcttgcttgacttaattatgactgattgtgacagcttacatctttagtctgaaaagtatctatgggggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctg

SEQ ID NO: 11383 - DNA, 571 bp, Homo sapiens
  ENST00000570216
acctcgttccctggtttccctgatgaggcagttggaaggaggaggcagaccagtcctgcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcc

SEQ ID NO: 11384 - DNA, 567 bp, Homo sapiens
  ENST00000562933
gtgccaccgccccggactgttcccgcgcagcgaggtcccttccccggggcccccgggtggggccggtcgagccggcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccc

SEQ ID NO: 11385 - DNA, 554 bp, Homo sapiens
  ENST00000563316
agttggaaggaggaggcagaccagtcctggtgagtgtccggggtggcaaggattgcagtctcagcggtggcctcagctctcacagcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcgggg

SEQ ID NO: 11386 - DNA, 685 bp, Homo sapiens
  ENST00000567605
ggcatcgcatcgtggcgagcaggaggcaggagcgggacgcgcaggggagccgggaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacgcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcc

SEQ ID NO: 11387 - DNA, 501 bp, Homo sapiens
  ENST00000568951
agaccagtcctggtgagtgtccggggtggcaaggattgcagtctcagcggtggcctcagctctcacaggcaaggagcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcct

SEQ ID NO: 11388 - DNA, 569 bp, Homo sapiens
  ENST00000564066
agctgtcagcggcagccgaggctagcgcgggacgtcgccaccctagcgccaggccggagctagcagccgcggagccgcggagagcggagggggcggcggggccgggcgtggcgggtcccctcgccgcccactgcgcgctcgaaccctgggccccgcgagcggcgggcggcacccgctgtaatgcggagaatcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgac

SEQ ID NO: 11389 - DNA, 3044 bp, Homo sapiens
  ENST00000379992
tgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtgaagtgagaaaaacagaatgcagctttcaaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaaagagtaaaccaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttgatacagaa

SEQ ID NO: 11390 - DNA, 498 bp, Homo sapiens
  ENST00000493941
agatgctgctgcccatgacatgcgggaattatcatgatcaactacccagcttggatttcacccagtggccaagagctttgtgtgggagacggcaagggttggatttttcaaaagagtaaaccaggctaccttctcctgccacagatactctatcccatttgctgtcatccaacgactaacaccgttttcacttcagaacgtcaagccttttctgttctcttcatggcctcctcccattaaagctgaaagtatctgctatcagtcatttgtcctaactgagtaagagtacattctttttagaatttaagaacctacactttagacctctcttcactaattatagaatccatcattcaacaaatatttattgattgcctactatgtgccatgctctgttccaggctttaagggtgcagtggtagcaatcacagataggaccccattattctgtctacaccttgtgaggggagatagtcaataaagaaacaaacaaaataa

SEQ ID NO: 11391 - DNA, 2981 bp, Homo sapiens
  ENST00000613945
ttgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtaagtgagtctcatcttgtttgttgcaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaagattcatgcagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttg

SEQ ID NO: 11392 - DNA, 3031 bp, Homo sapiens
  ENST00000308675
tgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtaagtgagtctcatcttgtttgttgcaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaagattttctcaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttg

SEQ ID NO: 11393 - DNA, 2323 bp, Homo sapiens
  ENST00000577628
aatgaggcgaggtcggaacaggatctgctggctccggctcggtttcctcgcacaggtctctccagctggatcctcgacgctagggaggaaggggcgcgggactgctgtgggggttttccctccccaggcaggggcaggacctgttccgggcgactgcagggttaagggtatcgtcttaaagagccggatcctcccggctggagcgaggctggatggcgggacgcagcctctcagcctctcgtacccgccctgcgtccgcagtggttgttggcgcagccgccccgtcggtgttccgggctcagtccccgctccccagcgccagacgcagactccgggccaagttctccctccgctcgctgctttctgccgcaggacccggatcaataaagggaaggagagccgggaggaaatgatggagaacagagagaaaggagatgcttgatttcactcgccaaggagtgagtgctcatcggcagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagttttcccaacatccctaagccgccgatacattatcacccacgtattgcggacgagagaaccgcctcggagaagctggctggctcgcttggagttttgcagctagtggcggagcgagcattccgagcaggtactgtgcgatcctccagcgccggccgcagctcacagccccttagctccgccgggttattgtgcggccgcgccttctgcacctgttgcggccctcgctaggcgggaagggagggagaagaggaggacaaaggggatgaccaggtggctctcccccgacggactcccggcccagggagcggatagaccactcccagagagagtgtggctttgagccttggagaggatgctctccttctccagggatcgcctccccagcggacgcagagtttcagggaaatgtccgcctccgccacttgggatggcagtggggagaggaggatctgggtgtccggaggagggcagtgggagaaagctggagctgctggagtcgcagctgcctgcggagcgggcccgggaggaagcggggccgagcgtgcggcgtccacgcgataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagaggtaaccttcagtccctggagtgtccctgaggaaggcccttaatacctccttcttaataccatgctgcagagcagggcacatcctagcccaggagaagtggccagcacaatccaatcaaatcgttgcaaatcagattacactgtgcatgtcctaggaaagggaatctttacaaaataaacagtgtggacccct

SEQ ID NO: 11394 - DNA, 505 bp, Homo sapiens
  ENST00000583083
cagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagttttcccaacatccctaagccgccgatacattatcacccacgtattgcggacgagagaaccgcctcggagaagctggctggctcgcttggagttttgcagctagtggcggagcgagcattccgagcagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaac

SEQ ID NO: 11395 - DNA, 10441 bp, Homo sapiens
  ENST00000261292
aaaaactacctctataggagcgtgacagcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaatggtctgacaactcaattttttttttttttttttttttttttgagacagagcctctctctgtcacccaggctggagtgcagtggcaatcttggctcactacaacctctgcctcctgggctcaggtggtcctcccacctcagccttctgagtagctgggattacagagatgcgtcaccatgtctggctaatttttgtatttttagtagagatggggtttcgccatgttggccaggctggtcaggctgggttcgaactcctggcctcaagtgatccgcctgcctcagcctctgaaagttctgagattataggtgtgagccaccgtgcctggccaattcttaaagtttgaaagaatatagctgccccaacctagagtctgacaaaaagttactctaatataaggcatattctttatttgacactcatcgttagcagaagtggacagcaattcactaaagaaccagaacaagaacatcatttcactgaagacgagaagaaaaattatttcaattgtagcagcttgaaggcctgaaggtggatgttaggaagaacagggagcatggctggacactggggagcattagtgagattattaggtttggttgaattggaactagatatcagtgacttagaccagagggaagctgatttctctattggttaaagtcccagctggtagtaaggttctattctacaggccaagagggctgcaggttcttagtttttcactgtgccattcatggggtattcctcgcatccccacagcccaggggtcccctaccagccaatggaaagccagaaaagggaagggatgaacagtctcctcttaaagacatgactgagaagttgcttacattctattggccagaaataaatccatggtcacatgacaggctgggaaatacagtctttatttagggtgcccatgggccctgctgaagatccaattactatttatttaaaattgacatataataattgtacatatttgtggggaaaatagtgatgtttcgatacatacaaggtatagtgatcatgttggaataattagcatacccatcctttcaaacatgtatcatttctttgtgttgggaacattcaatatcctccttctagttacttgaaaccatattttattaactctagttttacccttcagtggtataggacactagaatttattcctcctgtctagctgtaatcttgtttgtttcgtttggtgttttttgtttttttgtttttttttgagatggagtcttgctctgtagcccaggctggagtgcaggggcatgatcttggcccactgcaacctccgcctcctgggttcaagtgattctcctgcctcagcctcccaagtagctgggattacaggcatgcaccaccacacccagctaatttttgtatttttagtagagacaaggtttcaccatgttggccaggctggtcttgaactcctgacctcaagtgatccacctacctcagccttccaaactgtcgggattaccggtgtgagccaccgggcccagccactagctgtaattttgtatcttttaacaattccgtccctatttcccctttccccctaccaattactatttattaaaagggaaattggatcttgccatccgtttatcaggaattagttttttctctgctaaagccagcgagatagaccagagtaccctttaaatgattaaatcctgtagtcaatttttagtaatcttaaattgatctatgactatgaagtataatgcattacatcagtttgactttatttctggtcttaagtgtgaaaacatttctaaatgacaaggaagctctttataaagggctttagtgatggtggaaactccactgtccatctctaccaggacattctgaaaccaggcttgataatggctgtagggagttgggttagacaataagagataagttcttaacttggttcagatgtcagaggaaagcagaaaatggtgtctctggcatagtaaagaaaattgttgaaatttcccaaaggaagagtcatagcctggatgactgcaagtgccttctttggcttgggggttcagttactagttagagtcaggggaacttccacaggacttcctttgactctccaaacaagctgaagccccagaccccttggaaggatggatacaaagtaggtactagaacagtctttgtcatcaaatatggtatttctcaggtgtcacctctgtgttcagagctaccctgagccctctgccatgtaagctctctgatggcacagatttttatctggcttgttttctgccgttatcttagaagctagaatagtgtctggaacatcatgggtattcaatgaatatttaaataaatagatgaaattagatataagaaactaggtgcttaaacaggcaggaggtaatctgggaaaagagcagttagtttggaatcagaattcttggtgtgtcatccagcattatgtgagttttaggctaaatacagcctttctgagtctctatctgctcatttaagaaacagagacaatactgctcagggttgttgtgaatgttaaaggtacatggtaaaaaagaaagtatttgtgttttgtaaacatttgaattgataagaggacagtgtgagacaaaaataaaatcctgggtgggcacggtggctcacccctgtaatctcagcactttgggaggctgagatgggaggatcacgaggtcaggagtgcgagaccagcctggccaatatggtgaaaccacgtctctgctaaaaatacaaaaattagctgggcgtggtggcacgtgcctgtagtcccagctacgccggaggctgaggcagaagaatcgctcgaacctgggagatggagtttgcagtgagctgagatcacgccactgcactccagcctaggcaactgagtgagactccatctcaaaataaaataaaatagaatagaataaaataaaatcctttccacatatatgcggaaattttatgtatgataaaaggggcctattagtctttgggaaaggaatggatggatgatgagaaagtaggctcatttgacaaagagaaacaaaattagattcctattttaacacgcaacaaagatgaattccaaaatacctattgggtactatgcttattacctgagtgacgaaataatctgtacagcaaactcctgtgacacaccatttaactacataacaaacctgcatacgtacccctgaaactaaagtagaagttaaaaccatcaacccccccaaaacaaaaatgaattccatctgaataaaaggtataaatgtgaaagtcatcatgctaatagatattatgaaatataaattcaaaacctgtataaaaactgaaaaaatgtaaaacgtcacaattagaataagaaaatttaaatagaacaatgaatattaaataaactaaaatgctaataaaatgtactccttagggccaggtgcggtggctcacacctgtaatcccagcactttgggaggccgaggtgggtggatcacctgaggtcaggagtttgagaccagcctggccaatgtggtgaaaccctgtctctactaaaaatacaaaaagttagccaggtgtgatggtgggcacctgtaatcccagctacttgggaggctgaggtaggaaaatcacttgaacccagaaggcagaagttgcagtgagcctagatcacggcactacactccagcctgggcaacaagagcaaatctctatctcaaaaaaaaaaaaaaaaaaaaaaaggccacagaaatgtccatccagcaggtggacaattacccttttgtcagccgttcctctgttgctgaccattagatccacatttcttttctgtccgccctggtcccctggtgccccctttcctggcccctgtgacatattgtcatgtagctccaagtatttccccccctcatatccctcaagtgctccattttccaaatgcatttgacttcctactctcttagccccagctctctggtattctgtgtagctgacttccacaagggatctgttgggagcttgtaactgaactgaagtcatgcacattgtcaatggctagtagacctttacctggtccagagttgtctgcattgtttaaagaagacgtttgttaatccaaattaatctttgatttgcatggaggcagtaggtcaaatcaaaaggaaattttcctctccctagcaagcaaactcagaaacaaacaaacaaacgaaaaccaagaaacaaaaggaaaggttcctgttgggatagagaaacagtggagcagggcagccaccttacacataggctagatctgcttgggaatctttcttctaatcgaggcccctaaaatattcctgattttcacagttgatttcatttcttccctcctgaacttacagagcctttcagtaaacaccagtatttgtccctccccgtgtatgcccagtggtttccatggcagcaacggttgccatagagaggtgaagagaggtgtcggtgccctcttttgtaactgtgggttatctatagattgggggtggcctctcctaaaaaagactaatatgtaaataaaaggaataagaatcaaacaaatataaatcagggctcaagtcatttgttttcctaaacctttgtggttatccataccatttaaccttgactttccttaaatcataccggtgcgtgtgtgtgtgcagagggaaagggctgcaagaagactctggaagctaggacaggtctcagcaggtgagggctcaggcccagaggccagctggggcagcagggagcagagttatctgggccatttgctaattatctcagcccagacgagtctgcacgctatgtggtttaataccttcaccagaggcaaatggttttggactcacaagaattgctcatggccagaggcaatggacagatgccatatgagaaagggctgaggccaggaacagaggcagggttatctcactggaatggagaagctaaaatgacattatctttacttctgccctggttattatcccaaggcaacttcagtgggcttgttttgaagtcaaagcctcaactatttattgtgagggagataattcattttcattttcctgccagagatgtcagtcttactattcatcctgtatcctctattagatacacagagcttcttccttctgcttaggctgccccaaattccatataggattctttttgaagaatatatatcatccaaaaagaggtcctaggaaatgtggcttcacaaccctggggtttgtttccctggctgctgtctctctctctctcttttttaattttttttggagacacggtatcactgtgtggcccaggctggagtgtggtggcgccatcactgctcactgcagcctcgacctcctgggctcaagcagtcctcccacttcagcctcccaaatagctgggactacaggtgtactccactatgcctggctacattttgaattttttgtagagatggggttttgccatgttgctcaggttggtctcaaactcctgggctcaagcaatccacccaacttggcctcccaaagtgctgggattagaggcatgagccatcaggcctggccatgctgcctctctctccttcaaggtagacttcctctttccttccccttctccctgcttctttctccttctcctctccttctcctcttctccttcttcttctcacagctttttattgacttataacaggcacacaataaactgcacacaggtaaatcatataatttgacattttggtacaggaaatcatcatgaaactgaaagcattaccacatcgagattgtgaacataccaccaccagaagttttcttgtgcccctttgtaattcttcccactgccctctccccaggttgtccctgatctgctttttgtccttgtagattagttgcattttctagaattttgtataagtggagtgtatctacagtatgttctcttttgtgtctgccttcttgtactcagcataattattttgagattcatccacgtctttgcatggatcagtcatctgttccattttattgctaagcagtattccactgtatagataaataacattttgtttatccgtttacttgttgatgaactttaagttgtttccagttttgagttattagagtaatgctactatgaacatttgcatatgaatccttgtatggacatgaactttcatttcttttgggagtaggatagctggatcatatggaatgtatatgtttaacttttaaataaactgccaaactgttttcc

SEQ ID NO: 11396 - DNA, 1760 bp, Homo sapiens
  ENST00000427224
agcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacagcaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgt

SEQ ID NO: 11397 - DNA, 1453 bp, Homo sapiens
  ENST00000580036
ggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagaggtaaccttcagtccctggagtgtccctgaggaaggcccttaatacctccttcttaataccatgctgcagagcagggcacatcctagcccaggagaagtggccagcacaatccaatcaaatcgttgcaaatcagattacactgtgcatgtcctaggaaagggaatctttacaaaataaacagtgtggacccctttt

SEQ ID NO: 11398 - DNA, 565 bp, Homo sapiens
  ENST00000579750
ctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggtactgggggatgagagggagtctcctgtcaccagcaggatctcaaacccaatcttcttaagaaatgcaggtcatgcatctgttgccatgaacttctggagtctgataaaaatctttgagattaaaagttttattgaattaa

SEQ ID NO: 11399 - DNA, 3548 bp, Homo sapiens
  ENST00000623277
tatttaaatgtgtacatttcaaagtgtttccacatatattaacttcattgatcctccagacaaccatgtagattggacacacccaggaaagatgactaaggaaggctattctttttttattgagacagggtcttgctctgtcacccaggctggagtacagtggcatgatcacagctcattgcagcctcgacctccctgggctcagatgatcttcctacctcagcctcctgagtagcttggattacaggaatgtgccactatgcctggctaatttttgtagagatgaggtttcaccatgttgcccaggctggtctctatctcctgagctcaagtgatctgcctgcctcggcctcccagtgctgggtttgcaggcatgagccactgtgcccagtcaggatggctattcttatgataaaggctaagatatttattcttctttcccgctttggaattcatatacctgagaactctatgattcaccctctcactactaattttagaaaacaagctgtccttttccattccctcaaaaacaataggagtccaagtaataaatgaacactaggaagtcatagcatcatatgtaacatgtttagcatcctccctcctgacatggatgctgttcacatgttcactgataaggagcctgagattcagagaggttcagtggtgtgttcacatagctgagactagaatccaggtctcctaactctcagtcttgccccctttctgccaatacagtgtctctcttgtatttctagatcaaggcaaagaggacactttgatagttctccccacacttgtgtgtccatgattgtgtgtgtgtgtgtgtgtgtgtgtgtgtgtgtgtatgttgtgggtggataatatgtaaatgcaagaactgtgatgtactcaactcagggtccagagggtgctgcagtgtggtgtttctcaaagtgcatctatggcttgtcaggttagggagagaaggcagcactcgggaccttgtccatttattctgaaaggaatacatgtaaaatagtcccataggggtgtcagaaagcttggccttaaggtcaaaagagcacaccctgaatacaggtttgcgcgtttgctggtgtgtgagctaacaaatgccactctcacacggtttctttcagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttctt

SEQ ID NO: 11400 - DNA, 2632 bp, Homo sapiens
  ENST00000571688
gctaaaaactttaccatcttcccagttcactcccagtcggtcttaggagacaggaccgctattgtgcccattttgcagacaggaagccgagctcagagaggatgggtaacatgcccgaaggcacagagagtgtcttggtctgtccggacgcgtctgtagagttacaggaagagaagggccgccctccagagggccgggagcgccccagcgcgggtccggggtcgaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaagagaa

SEQ ID NO: 11401 - DNA, 2292 bp, Homo sapiens
  ENST00000413364
ccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctccgcagctttgatctcctgggctcctgcaatccgcccagctcagcctcctgagtacctgggaccacaggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtg

SEQ ID NO: 11402 - DNA, 2356 bp, Homo sapiens
  ENST00000339430
gtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggt

SEQ ID NO: 11403 - DNA, 1118 bp, Homo sapiens
  ENST00000570904
caggctgtcgggggcggacgggtggggctggcaccgagaggcaggggcaggataggagagtgggggagacaccaggtccgcgccaggcgtctcgggggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaa

SEQ ID NO: 11404 - DNA, 677 bp, Homo sapiens
  ENST00000571459
caggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagt

SEQ ID NO: 11405 - DNA, 582 bp, Homo sapiens
  ENST00000575426
accgaagtgactctgccaaagagtctaagtgaagtgccattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaa

SEQ ID NO: 11406 - DNA, 773 bp, Homo sapiens
  ENST00000573332
agacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaatgaatgctattggccttgtttcctgagcaacctgtgtttgtccctctccctttcatcagttaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttgga

SEQ ID NO: 11407 - DNA, 516 bp, Homo sapiens
  ENST00000572255
agacctcccggctcgacaggcggcgcgggcggcggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacagttaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgca

SEQ ID NO: 11408 - DNA, 603 bp, Homo sapiens
  ENST00000576036
ccctgcgctcagccttctgagccttcctcatctgatgcctgttaggctccctttgctgctgaggtcctgggtgccatcccagcacttggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagc

SEQ ID NO: 11409 - DNA, 717 bp, Homo sapiens
  ENST00000574763
agacctcccggctcgacaggcggcgcgggcggcggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccag

SEQ ID NO: 11410 - DNA, 579 bp, Homo sapiens
  ENST00000571627
aggaaaagaaacccgccttgagccaccgcagctcgtgccaggggtctcagatgatggacagacactgatatggaggttcaaatttcgggaaacacagcaacagcccagccatggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctct

SEQ ID NO: 11411 - DNA, 593 bp, Homo sapiens
  ENST00000570798
gacctcccggctcgacaggcggcgcgggcggcggaatttccccagagctacagtgagggtggaaaaaagaggatctgcaagaggaagtcctgtattcttggcactgtgacttgtcctctatttgttttcgcttttacagcagtgaaaatagccccgtgggtgaggcggtctatcaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcg

SEQ ID NO: 11412 - DNA, 553 bp, Homo sapiens
  ENST00000574701
gaaagtggggagagccgcgagcggcaaatcaggagggagggccaggctgtcgggggcggacgggtggggctggcaccgagaggcaggggcaggataggagagtgggggagacaccaggtccgcgccaggcgtctcgggggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctcc

SEQ ID NO: 11413 - DNA, 548 bp, Homo sapiens
  ENST00000571976
ggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgagtctgcctcccacttggccccaagccatcctgcccttctctctgggtgctggcgggggtgggttctcaactgcaccatgcttgacattcagggccagacatttgtg

SEQ ID NO: 11414 - DNA, 486 bp, Homo sapiens
  ENST00000574703
agacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtacgtgtggcctcccaggccccccttaccattccttggccctccaccctgggaatcaggagagtgaccgaagtgactctgccaaagagtctaagtgaagtgccagtacgttccagttttacccccttaccttgaaattccacacgcagtcttttagattccatgttggtgaggctcacagcttttccgtaataaagtatggtttaggatctttcccatggtcatca

SEQ ID NO: 11415 - DNA, 554 bp, Homo sapiens
  ENST00000574848
aagcagtaacccattttctctgggacccctttcttcgcagagagcgcttctctttctttcgcctattacacttctgctcttaacttcagtctggtgtgtccgcatcctagttttgcatggctgtcagacaacaaatctcggaccctccagccacatctcctgtaaataccccgtgtctttgtgctacccagagcccgagtctggccccatgtgcccgtgtaggtgtggaaccctgccacctgcgacacaggtcttcgaggagtcaaaaagggtaacttcctgacgttgccatgacatttgtaaactgtcatggtgctggtgggagtgtagcagtgaggaagaccagagttcgccctcgtcgccgtcttggttttggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcct

SEQ ID NO: 11416 - DNA, 587 bp, Homo sapiens
  ENST00000571277
agacctcccggctcgacaggcggcgcgggcggcgaattataaatgtgtttgtgtggctgtttgatctcaaagcaatgctcagaagatgcagtgtctcgaaatcccagaagataagatgttaccacatgaaagatggtctcaataaagggggagaggcggtggccgaggccttaatttccaaaacgagaaactggggcccacccatcttttaaaggtcgtcaaaagaaagctcccatcctcccatcccccacacctgtgtgttgactctgtaaagatgcagtttcctcactttgggaggagaggccgtggtttttgcaggaattgcgccgctgccgaattcagccattgcctcttggaggtttaggatgccccaggccttgttttccctcaaagcattccattggcaatcacgaccaaccatgctccttgaggatttctgtacacactggcttttcctggtcttgtaaaatgtcggttccaggaccttaccaggcggccactgggccttcctcagcaccatccgcacctccatcctatgaagagacagtggctgttaacagttattaccccacacctccagctcccat

SEQ ID NO: 11417 - DNA, 556 bp, Homo sapiens
  ENST00000576334
agtaacccattttctctgggacccctttcttcgcagagagcgcttctctttctttcgcctattacacttctgctcttaacttcagtctggtgtgtccgcatcctagttttgcatggctgtcagacaacaaatctcgggtatttaccccagacaacgacgctgcttcactagcacccattccatctggagcaagcacacctgattgccccagcccggctccgaggaggctggagaattgcaagccttctaaggagggaaatttctccatgcttgggatggagctcagagcctgggtagccccacacaataccctccagccacatctcctgtaaataccccgtgtctttgtgctacccagagcccgagtctggccccatgtgcccgtgtaggtgtggaaccctgccacctgcgacacaggtcttcgaggagtcaaaaagggtaacttcctgacgttgccatgacatttgtaaactgtcatggtgctggtgggagtgtagcagtgaggaagaccagagttcgccctcgtcgccgtcttggttttggtaaaatgtcggtt

SEQ ID NO: 11418 - DNA, 692 bp, Homo sapiens
  ENST00000620789
gtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctccgcagctttgatctcctgggctcctgcaatccgcccagctcagcctcctga

SEQ ID NO: 11419 - DNA, 2467 bp, Homo sapiens
  ENST00000622633
ccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaag

SEQ ID NO: 11420 - DNA, 1527 bp, Homo sapiens
  ENST00000381810
ggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctgggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcactt

SEQ ID NO: 11421 - DNA, 8405 bp, Homo sapiens
  ENST00000157600
ggacagcctcgcgctgggattggctggcctcgcgcgagcgccggcgcggagtggctggcgaggttttagagggagtcccgctctccaattaaagcggcccagctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccacatacacccttatctaattatttacaccatggcagtgattttgcaacacccagtgctggcagaaaatatagtaaaatactaatgagcctctctatcaatgtatctcatcagacttccactgggagtgtaggctttgggacagaacccccgccccacctgcctattccagatactcccagatcactaatgtaacaaaggtatcatgttttatggtacactgaaaagtggcctgctgggaactgatgagcttctctttagccagggacctgactcagctgccctcagagcccaggaaaatagcgaatgaacccctctgggaataagaccagtactgggaaaccactgaacaggggccacctaagctccaccaatgggtgccacatgggatgtggtgactaatgtgggcagatctttaaaaatacagcactttttcaaatgccaaaacaatcagaaacaaaattttttcaataaaaattaatctaaaatttaacaatgccacttttatgagaaatctcaatttttaatgttgccaactaaacattgaatgagtcacgtagaataggtctttgggccaaattgtatctccattttatggtctctctgaacattttcagctcttaaattaatttctttcccacagtttctaagaaaaacatatttttctactgggagtataaggatgaaaaagacacaagtcctaggagcttacggtctggtcgccagtggttttctttcttgaacttcctcatctgctgccagttttctttaacctcaccatccaaatttcactctgaccatctcgtacctagaaaacccccattcatgtgctttataagtttcaccaaagccattgctatatcctcccaaggcagtggttttctgctcccagctcctttctctagtcaccctcagtttcctcgtcatgttcatcttctcaaagataagtttcaagtgtgtcatttccttcactcaatctccatggctcttcattgcctgccaagttaacaaccaagtcctcatggacatttgaatccttccaaaacttggcttatgtctttctggccttggagccctttatttccctagatttctagttccctatttcttcctaagcatgcagaagctccctctgatcaagcccttccctttgcttttgctagttgaagactggctacctgaagaccaactctggctgttgaaattctattcatcctataaggtgcttctcaagcataacctgcttctctggcactttcctgaagcaccagtgaaatattcaccaattcatcattcattcatccattccacaagtatttcagtgagcacggcaaagttccaattcccatgctgaatataggggatgcggggtgcacaaaaagaacagtgacccctacgcccatagatgttacggtctgtgggggagatgggcctcaagcaaatattctcacaagtcaatgcaaaattacactactgtgcatgctataaaaggaagatttgtgttactataatgcatgtaaactggacttaggaatatcgagagaggtgcccctgggaaagtgatgcttgaactgggctgtaaaggatgagtagccttgccaggcatagtggctcaggcctgtattctcagcactttgggaggccaaagcgggtggatcacttgagcctaggagttcgagaccggcctgggcaacatggcaaaactccacccctacaaaaaatacaaaaactatctggcatggtggcacacctgtagtatcagttactctagaggataacctgagcccagtaagtcaaggctgcagtgagctgtgatcatgccacagcactccagcctgggtgacagagtgagaccctgtttccaaaaaaaaaaaaaaaggataggttgcctctaagttggcaaagagaggaaggacaatggttaaagatggatacatgaatgcatgtgcaaaggccctgtggtggaagccccaccagtttattcaacacctatttgctggtgttggagatacagtggtgaacatggcccatggatggaactgaaagaaaactggtgtggcaggagcacagagcatggtgaggagggtgggcctggggcatgagaggcaggcatggccagcctgctccagttctggggcaattcaaaagactggtctctgttctaggagcaagggggagccttcaaacagctttaaggagggggtggtgatggctggacagggagatcatgagatacgtcatctcttctctgttgaaaccccagcacaatgcatgattgacttggtccactgggtcacaccatcatggatgggcattatctcccacaacagtccccatggggcaccacccagcacctgcccctgcctttctcatgtctattaatgacacccacccttgcatttggagcacctgaatcatctctgccacttgccttcatatctgatgggtcactcagtccagtcctttctctccatcctcgctttcactccatccccaaagtcatatctcaccttgaacattttctgctcagactgacaagtctccccgacgggaactcaccctctccacccaccacttccagatgaattgctcagaaacacaccctcatcttgcactctcctcttcaagaacaatcaggggctccctgttgcacacacagaaaaaaattgaaactgttttaccttgcagtcgagtttcttatttttcctgccccaaccctccttccttcctgttatcctttcagaagccaaatgggcagtttacagtcacagtgtgtgcccctgctttcctcacctctgtaccatcactcacgctgtgctttttgcctgcaattccccacactgtgtttaattgctgcctctgctggggggctgcaatagctgagtgggattctgtaccagaattggaaagatccatgttaactcttgcctgattctatctcccatgtcagcaggaagaggggctgccatccccacccctcccactctctaggaagactttcctccctcacccttcccttggggtgttttaggtgccctttatctgtaagttcataatatcccaggcttacagtaattcttccaaggcctttattgtgctataattatttattcatgaaagccttcccctatgaacttctaaagaataatcgtattatctttatttccccaactcttagtacaaatcctggcaactaaatgaaagaacaaacaacctggggttctgggatggttcgtctttgctgatggcactgtgttccaaaatggccaaggtcaaatataaaaatttcagactgaggtagacactgctggcagcctacacattgccaccacaccccacttccttcttcctagtggcaaggaagcagtgggtggagagggtgagttcctgtcagggagacttgtcagtctgagcagaaaatgttcaaagtgagatatgactttggggatggagacaaagggaggatggagagaaacgactggactgagagaagagcccactcccctttatgtaaattggctttgccaacctggtctgcagctggagaaaggccatgcgcctctattaccagccagtggggcttccgccttaggagggtcttagaaaagtgtttttccttaatgaaaggagatactgtgcagtaaatagccctgctgttgttttcttttcttttgatagaatgtcaaacttacgaaaaaagttacaagaagagaacaaagagctattagagggtgttgctgacacaatgctttatcactcttgaatattttcgtgtgtaattcctacaaataaggacattctcccacatagccacaatacaaccatcaaaatcaggaagttaacgctgatgtgtttctaccatgtaatcctcagatccaattcaagtgtcaccagctgtcccaataatgtcttttataacaaaaacattcagtctaagatcactcattctatttagttatcttgtctattcttcaatttggaagtgttctttgttctttcctgaatgttcatgaccttgacatcttagaagattaaaggttatttaaagttgttgagttaaatatccattaaattaggtttgtcagatatttcctcgaaattagattcagcttatgcattttttggaaggaataccacagaagtgatgttgttttctttctgttgcatccaatcagatgatacaggattttgatttgttccattactgttgacatgaattttgaacatttgataatgccagtatcagccagatttttccattgtaaagtcattcctttgtcctttgtatttaataagtatgtttagggactttgagactatgtcaatgtcctgttcttcatcaaaattccactcactcattcttagtattcattgacgtttactgatcgaactaattattattatgatagttgccaaatgttggtttttctaattcaatcatttctttagtgtttattagcattctactataaggaaaagcactatcttctccccatttattaattcacatatttacatcagcttggagttattgatttctattttattaaatagtttataattgattaccatccttatttattttaatgctcaaattgtcccaaattatggccaaagaaagctccttcaaactggttgctatgtccttttgacatggcccatcattctttaaacacattttacatctggcacaataacgtgctacatacccatcttgtatttttcctgccccatctttgaaatcagccattctcaaggggttccttcttaatctggctgttgttgtgttggaactcctggtaccatcttagaaccttaaggagacaagcgaaccaagccaataagctttccatgatgctgcttagagttaaacagagcccaggtactaagttatgtcatggagacagtgaactaacctctggactgcttgctacatgagacaattgattttcttattttctatgtagggtggtacatttcctcattttgagatatttcttcaacatatagcttttcattagtggggattttgtcaattataaccaaaaacaatgtgacggatacccaagatgtttcatgttgtagcttgggtgaattacacatttctgaagccattacacttcctagtttatttggatttaagttgacaaataaaaattgcatatgtttatggtctataacatggtgtttcgatatatgtatacatcgtggaatggctaaatcaagctaacatatccattacctcacatagttattttttgtggtgagaacattttaaaaatattgtcttagcaattttcaatcaagcctgtcccatggagacacaagcaatagtgacatgagcacttgactcgctgggttatcaggctttggctccaaatgtttggcttcaaatatgaaaaagttacatgaaagatgaaactatgcaatggcatggctgttggtcattcacatctctctctgccaagaatggggatgacgctgttgaaggaagaaatgtgttttctcctttttctcaagtgatatttgccttaggtcagattctactagtttaaagcaaaacgatctcctggtctgattcctttgggtctctaataatggaaactgcaaggatcagcataaagtgttcctttgttctgacgttggtataacattgcttcttgaaaaatgaaagtatttggacatacagacagaagcaatattattcaggtcttccttgttgcaagtgagggaaatccaattaaaactggtttaaacctaaaaaaaaaaaaaagaagaaaagaaaagaaaaaatatgagaggggttttgctttctggaatctgctttctagtcagaaagtgcagaagaagggctagcttcaggaacaattggatgcagtagttcaaatcacaagttaagtctctgcttcttttctccatctctcttctgtcttcctccacactggctttattcttaggtaggcttacccagatagtcataaacacagccaccagtggcagctgggctcacttttgtccttggagccagtgagcccatgaaaaaggagcttctctttctggagcttcccaggggtaactttgatcagccaacaagggtcagtcctatgcttatcccttgaccaatctctgtgcccagagggcagggtactctgattggcaataccttcatcgtgggccaaccactgtggggaagggggagggattagaaaagacagccacacccaaatctcatgaagcagtcccctttattttaaaaaagtccctgtgagagcaacaggagcaaagcatggagaagaagcaatcttggagaagctggaagagaactgacccaaagaatccaagagactaagactgtgcagggttggggaacggaagctcacacaggaggcctggacagagctgcagcagagccaggagagaagccaagtggcacagctcatcttgaagtaattataatgccactaaaattctcatttgtattaattttttttaattactggcaagataaggcaaatgtttttaaaggcctaaataaaatgatattccctgaaggaaa

SEQ ID NO: 11422 - DNA, 1431 bp, Homo sapiens
  ENST00000426878
agctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacaagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttgagaaaacagaaaggagaagccagagttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacaaagctgctgccacatcca

SEQ ID NO: 11423 - DNA, 870 bp, Homo sapiens
  ENST00000415597
gcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatggtgatcacatgggatatacatataaagtaatcgagcgaatactggagattggtgcatttcgaccgcatatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccac

SEQ ID NO: 11424 - DNA, 579 bp, Homo sapiens
  ENST00000470776
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactggtaagagagcttccccaaccaagcagttgttttcctatcctcataaatactagccatgtcaagtgtttctgaatttca

SEQ ID NO: 11425 - DNA, 1113 bp, Homo sapiens
  ENST00000454244
attcagccgccgctgtccccgctgcgcgccctcgcgcctctgcctgagaagccaggcgctgttcccccaccccagaagaggatggcaaaggtggctaaggacctcaacccaggagttaaaaaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccaga

SEQ ID NO: 11426 - DNA, 1059 bp, Homo sapiens
  ENST00000456506
ctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattcta

SEQ ID NO: 11427 - DNA, 1501 bp, Homo sapiens
  ENST00000397386
agctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccacatac

SEQ ID NO: 11428 - DNA, 1232 bp, Homo sapiens
  ENST00000632043
gggtggaccggccgcatctcctcacagcgtctcctctcttcccagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggtggggaccgcgggtccccgggatctggcctccctccccaggccccgacccagcagaaacggtccctcgtatcccctcgctaggacggacccctacttccccaggccccgccccggccgccccctggtcctccagtacgccccgcggcccctgccccgccccaggcgcggagccctctagggccgcctttcccgggccggccgccgccctcacgaccctcgccccaccaggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgtaca

SEQ ID NO: 11429 - DNA, 2091 bp, Homo sapiens
  ENST00000621319
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagaccccgaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgta

SEQ ID NO: 11430 - DNA, 1051 bp, Homo sapiens
  ENST00000631419
cgaaaaacgcggaaatgcggtggctgcggcccgcgggcaggcgtcggggctgggctggcccagaactcacctaggggcctggtctggggtctccctggaggctcctggtaacaaacagccccaccccttctgggtgctggtatccatggcaacggtatacagcccttccctcccaggcctgcttggaggtcgggcctcagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttc

SEQ ID NO: 11431 - DNA, 798 bp, Homo sapiens
  ENST00000633856
cttccctcccaggcctgcttggaggtcgggcctcagctcccgaagaacattgagaatggcccccaagtctggccaggaggttaaagaaaccgaggaagaggctctcctgtcccccacagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaa

SEQ ID NO: 11432 - DNA, 608 bp, Homo sapiens
  ENST00000631522
acatagccgaaagttgcagagatgaagggtgaaagctggaatgattgggttttaatgggtcaggtctgggacctggcttttctcctggagcagagggaatacttgtcatggtaatggggtagcccagagggtgtggacacggctgggaaaagtgaggcttcagtttgggggtcagagcaagagtcggtcagtggtcacctgggacctccagcaggcgcacctgcagcccccgagactcccacgtgcctgccagacaccacgccccaccccacaccggtggtctgctctgccgacccgcaggtctgctgccgctgcaggttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggtctgcagcacagtccccagcccaacccaaccccgccctgtcctcgcccggactcctggtttctgtctgaccccaaccccaaccgctgaggcagatccttaccctcatccttgcccgcgctgaccctccaccctgatc

SEQ ID NO: 11433 - DNA, 1232 bp, Homo sapiens; identical to SEQ ID NO: 11428
  ENST00000469990

SEQ ID NO: 11434 - DNA, 2084 bp, Homo sapiens
  ENST00000329451
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccggcagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcat

SEQ ID NO: 11435 - DNA, 1051 bp, Homo sapiens
  ENST00000441853
cgaaaaacgcggaaatgcggtggctgcggcccgcgggcaggcgtcggggctgggctggcccagaactcacctaggggcctggtctggggtctccctggaggctcctggtaacaaacagccccaccccttctgggtgctggtatccatggcaacggtatacagcccttccctcccaggcctgcttggaggtcgggcctcagagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttc

SEQ ID NO: 11436 - DNA, 798 bp, Homo sapiens
  ENST00000486629
cttccctcccaggcctgcttggaggtcgggcctcagctcccgaagaacattgagaatggcccccaagtctggccaggaggttgaagaaaccgaggaagaggctctcctgtcccccacagagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaa

SEQ ID NO: 11437 - DNA, 608 bp, Homo sapiens
  ENST00000492515
acatagccgaaagttgcagagatgaagggtgaaagctggaatgattgggttttaatgggtcaggtctgggacctggcttttctcctggagcagagggaatacttgtcatggtaatggggtagcccagagggtgtggacacggctgggaaaagtgaggcttcagtttgggggtcagagcaagagtcggtcagtggtcacctgggacctccagcaggcgcacctgcagcccccgagactcccacgtgcctgccagacaccacgccccaccccgcaccggtggtctgctctgccgacccgcaggtctgctgccgctgcaggttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggtctgcagcacagtccccagcccaacccaaccccgccctgtcctcgcccggactcctggtttctgtctgaccccaaccccaaccgctgaggcagatccttaccctcatccttgcccgcgctgaccctccaccctgatc

SEQ ID NO: 11438 - DNA, 1550 bp, Homo sapiens
  ENST00000464025
agagtgggaaaaagcagaaggagaccagaggtgcccaggtagtgctgggcatgggcaggggcacagtgccacctgcaattgcctttgatgcctcttggtgccctgtgtttacttcttagacatctagggagtaaggtctggctctttcccgtcttaacccaaggttggttgggactctgcagtctggccaagggatgtgttgtcctgtcccttctcccttaggtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 11439 - DNA, 1519 bp, Homo sapiens
  ENST00000411482
cgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagagtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 11440 - DNA, 1687 bp, Homo sapiens
  ENST00000395833
ggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 11441 - DNA, 2294 bp, Homo sapiens
  ENST00000257818
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 11442 - DNA, 869 bp, Homo sapiens
  ENST00000465614
tgcttgctcgagctgttcgtgggttactttctgccttagttaaaccaaaagggaaaggcggaagaggggaagccctgaagaatgatttagtggttgcccagcctcctttccaaggagaggtgttcgctgagcggctctccccgtccccgacactggcccctttaagaagccaagaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcgg

SEQ ID NO: 11443 - DNA, 390 bp, Homo sapiens
  ENST00000493667
cgcctctgcagagcgcggccgcagcccggagcccgcagcccggagcccgcagcctggggcccgcagcccgtagcccgcagcccgcagagccgcgctgtccggggcatcccagtgcacggcgtccgtggacctgggacctcgaacctgggacgggcggaaaatccactgggaacacttgcatttctgaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaagggagcgcggtgactgtccttgagcgcggaggggcgagctcgc

SEQ ID NO: 11444 - DNA, 1295 bp, Homo sapiens
  ENST00000585258
gcggcgccgcggggccttagcggacggaggggagcgcgggggtcaccgggccgggccggcagccctagagctcggcctggcggggaccctgggccagccccgcgcctccgtggcccgggcgtctcgtgcgtgtccgcgaactcgcgtgcgcgcgtcacctcggaccgcagcatggctcggagggcggccctactcgcgccgccctagtgctgcgaagggcctcggagcccaaacccggaaccgccatctgggactgggaagacgacatggccagaagccgactggacagccggcaccaccccatgattcaaggatggccatagcccagtgcaggagcagatttgcttccagtttgcccttcctcctagagttttgctcttgtcgcccaggctacaggacaacagtggcgttatctccgctcactgcaacctccgcctcccaagttcaagcaattctcctgcctcagcctcccaccaccacacctggctaatttttggatttttagtagagatggggtttcaccatgttggccaggctggtctcaaactcctgcctcaacctcccaaagtgctgggattacaggtgtgagccaccacgcccagctgtttaatctctttttaataaaatatttcattgttatcattggattctcacagcaccatttgaggtatacgagcggtgttagtccaattttaacacacgtgctcaactcgtggaaaatgaacagcagagctgttctccagagatgttcagatctgcagcccagggcttttttctgtatgacctttacccacaacagctccgactccaattttttgagtttatacctggatcctacaccacccttctccagccctgtggtccttgacattgtttctttattcatctgcaccaaggactgaggcagaagtaacaatctgtttcaacaacatctacattcagaacatactagaagatacagcacacttcttacacggatcagcaattcagaaatgttctcttctcattttattgcttagagcttcacgttggtgggaagcttgtttggtcataaaaagaactgccaagcacagatacgctatgaccctgcaggttcctggggagaggcaacacatcttcattggagaggacagttgaatatgtctcctctgacacaactacacagacccctttccaagctctgcagccatcctccccacctaatgaaataaaatgtagatttctgttgtttaattgcacctaataaatcttttttttctttcaaccactttgaataaacatatattgtcaatcaa

SEQ ID NO: 11445 - DNA, 2162 bp, Homo sapiens
  ENST00000454869
agcgcgcagccggccgccctcaaccgctcccagcatcggttgccggtggttcggggcagggagacgacgcagcgcgagcggaaagggcggttacccaacggccttagctctcatggcgtcctccgtggtgttacctaaaaataaagttatttgtgattagaaggtaatcgcctcctggtcatgcttccgctggtcaacagtgtctgcggggcgaccccatccttgtggccagagagggcctgtggctgcgctcaaggcgggagcggtccttagcggggccctgcgggacgcccaggccgcgctcctttcccttgctcgcctggccttgaagtgaagggggaggtttaacaatgcagtgggaaccccaaagtttgtctcggccgtgctgctcacattccaaacaatgcaaaaggttgaggaaaacctcagcagttgaaaccgtgatgcatttcagcaaagaagtagctcctgtcctcgtaaaatcagtgaagttctcacggacgacctcattgaaagttttcatgggctgagctgctgacttcagcctgggaactgaggccaacatcggagtctcctcggcacacaagtttgaaagaagtcctagtgacttcaagctcagaaccatggacggcagggctccctctggatgtggaattctccgtccctttccagggagggaacaaagcccacaagcaccgagactccttcagggtgagcaaaggcctggaaaaacctgtatgcagataaagaaaaggaaagaaagagataatcagtgcatgcagttgtcagctggctgggacctgaggagagtcacttgtggaggcaactggtctttatccccattgtccggtacaaggcaggcattaatcctgtgatccttatctgaagctcaggtttgattttattcttttcttaagtacctactgttatccccaagcttataataatagtttaattgttacagccagtatctcaccttcagaagtaagatgcttaggaaaccaagacaaggaactgtgtgttgcaaacagcatcaccctggagaagaggtggcaggaggtgacctacagaaaatggagtaatagcctagagcaagaaacacagaacaaaagagaaatgaggggttaggcaacctcctggagcaccaatgggacaagcacatattcaggggcctcctaacagactcgacttccagcatcctcagatggtgctagacacgttacatagacgttcaagagtagagaactcagggacttctgatttatatcaagaaatgcatacacagcagacgtgtgcctgtggagtggaattctggaaaagctcacagcccagaacataatgcagactcccccagccacagcaccttccaaacctgagaagagtgctgattctccatctgagcacccattctcctgcaacatcaggggagaggatttcacctaagggtcagaccagcatctccaaacccagctccccacctttgcctgttggtggcacttgtgggagaaggggagatggtatgaaaagagccacaacaggagtcacctggacagggtggagcttgatggaaactgacatttgtgcccattggaggcaaatgtagaatttggtatcttccgtagcgtcaggcacatgaaactctccagtgcccatgacttttgacagtgacttcagagcacatctgggagacccatgtggcccaggctccacacaggcaggagctcagcttcactcacagcaggattcctagtgccaagaacaccataggtgcatagcaggtgatcaaaataattgtatgtggctgaatcagtgagaggtaagagagaggacttgatcctagctgcaaactaagagacctcattaaaacctaacatgtggctgggtgtggtggctcacgcctgtaagcccagcactttgggaggccgaggggtggatcacctgaggtcaggagttcaagacaagcctggccaacgtggtgaaaacccatctctactaaatatacaaaaaattggctgggcatggtggcaggtgcctgtaatcccagctacttgggaggctgaggcaggagaatcacttgaacccaggaggcggaggttgcagtgagccgagattgcaccactatactccagcctggcaataagagcaaaagtccgtctcaaaac

SEQ ID NO: 11446 - DNA, 4498 bp, Homo sapiens
  ENST00000311528
ccagagtgcattgcggggccgcttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacacacgcctgtaatcccagctacttggtaggcttgaacccaggaggcagagattgcagtgagccgagctgcaccactgtgctccagcctgggtgacagcgagactcagtctcaaaaaaagttgtacaaggtggatggttggaagcttgagcctaggctcgaatccctctcacgtgagagggcctgaagatttctggtggattccaacctggctgaagactggccgtggggggtgcaggggtctccagcgctctgccctccagcctgcttcctccctgcccacaccgcactaggggaagggcctttcctgctgcctgcggggccgcacctggagtaggtaatgccatgtggtgacgtgaatggagcagaggtctgtgccccatcacaccgccttgctgtttttactgtgggacaaaagcactctgatctgcgtgttccgggggccctcctaccagccgacttgacgggaagtcagggttcaggtatcatctgtgcacctggggcggggtagtctgcactgaacctgccagagtcccctcctcatttcactgaaagtcacagtctccagggctgtgttgctaaccttacgttctctccgtttgcttaatctattaagagccctaacaggagaggatgggctttctctgttgtctggggccctgctgttggccggtgctcttagcaagaggtcatttttctaggttgcgctgggacattgtgagtttggtgagggtcatggatgtgggctgggctgggctgggctgggccgggctgcctgctgcctgctgctcccctacctgaaatgcagctagtgcggctctgcccttcctggggctgaggaaggcttctgcaggatagctggggggctgggcaggtgggtgaggcagcctccctgctgacactcagtccttgtagctggagcaagatctcctgatccaggtacgggcctgtctgctccaagaaagactctgccaccagatgcaaaggggccctttgttttaacttagtccctggggaccgcctgattcagcacctgtcggcccaggataccccgctggtggggacaagtgcctgagtgtgggccgtgcccgagtgtggccatccctgagtggggccgtcctgactaggaagtggcttttcagttgtgatgtgtgggcctgacctagggggcgctgtggaacccgggctggaaccagccctctgtgccaggccgcagacaggttccgccggccctgaggggcagctgccatggcgtgggtcactgggagctgagaggaagggcccccaccgcacctcaggcaaagcggctctgggaacaccttgatttcgtccatgtgagccgtcccagggagggcagccaagctgtgaagcctgagaaactgacctgtgtgccacgagcttgtggtctgctgcccggtggaggaagtgcaggtgcgcccaggctcctcattccgttttgcaggattccttcggggtgtgagcatttcctattcagcctgtcgcccccggggagcacgggctggctctgtggtgcccgtggccttttgtagaagcgttggttttacggcaggttcatctctggggcagcctcccacagtgggtggggctttgccagcagtgcccacgggggtcatggggccaggcgcgctccggcgcctgcagaactgatcggggatagtctcaggaggcgctagtcacgtgccccggtgatcggggatagtctcagaaggcgctagtctcctgccccggtgatcggggatagtctcaggaggcacgagtcgcctgcctcggtgatgcaccgtttctcacaccggctgctctggcccgagctaaaggggaagacgtgtgcggataggagctgcacacaattttcctccatgtattgtttattttgctttttcttttggctagacattaggaatttcagttttcccaagttgtatttttccttttctattttaaaattatcatgcagggctgggtgaggtcgctcacgcctatagtctcaaaactttgggaggctgaggggggaggatggcatgagcccaggagtttaaggctgcagtgagccgagatcgctccactgtcctccagcctgcatgacagagcgagaccctatctcaggaaaaaaaaaaacaaaactattatgcagtagtttcgaccctggaagacgagtgtgcatctttgagttgtaacacgtgtacctcgcccatccaggcgtagtttcatttggaatctggttatcctgtagttgctttgttaaaaatatatgtaattgcaaatcatt

SEQ ID NO: 11447 - DNA, 698 bp, Homo sapiens
  ENST00000491523
gcttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgt

SEQ ID NO: 11448 - DNA, 2367 bp, Homo sapiens
  ENST00000563749
gcttcctttccgctcggctgttttcctgcgcaggaggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccaggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaa

SEQ ID NO: 11449 - DNA, 924 bp, Homo sapiens
  ENST00000484610
ttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcag

SEQ ID NO: 11450 - DNA, 554 bp, Homo sapiens
  ENST00000563270
cctttccgctcggctgttttcctgcgcaggagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaa

SEQ ID NO: 11451 - DNA, 712 bp, Homo sapiens
  ENST00000567815
cctttccgctcggctgttttcctgcgcaggaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgc

SEQ ID NO: 11452 - DNA, 615 bp, Homo sapiens
  ENST00000487034
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcc

SEQ ID NO: 11453 - DNA, 958 bp, Homo sapiens
  ENST00000562879
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctg

SEQ ID NO: 11454 - DNA, 568 bp, Homo sapiens
  ENST00000565571
tttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaa

SEQ ID NO: 11455 - DNA, 1455 bp, Homo sapiens
  ENST00000452368
tttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcat

SEQ ID NO: 11456 - DNA, 528 bp, Homo sapiens
  ENST00000467736
aggtgagggagactgggtcctggcctttgggcatcatccagcgccatcggcctggcgcttcagccaacgcgggagtggatgggccccttcttcttcgcagacagcgttcggccgctgcccgggctctagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctct

SEQ ID NO: 11457 - DNA, 2385 bp, Homo sapiens
  ENST00000393099
aggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtga

SEQ ID NO: 11458 - DNA, 879 bp, Homo sapiens
  ENST00000399461
ggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatca

SEQ ID NO: 11459 - DNA, 435 bp, Homo sapiens
  ENST00000570149
cgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatca

SEQ ID NO: 11460 - DNA, 631 bp, Homo sapiens
  ENST00000472354
accggtcatgcccgtccggaacgtaagtgaacacttactcaaatccaggcttcagacgagatcagtgggtgaacacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagcca

SEQ ID NO: 11461 - DNA, 1167 bp, Homo sapiens
  ENST00000637658
ggtgccagaaagggcttccccacaaagccgcccctcctggctctgaggcccagaagaatggccagtaaccggcaaagatcactcagagggcccagtcacccatctcatatggaagaacctttcctgcagatggtccaggccagcgagtccctcccaccctcccaaacgtgggctcagcgtgagttcttcctccccagcgagtcctgggagttccctggcttcacccggcaagcctaccaccagctggctctgaagctgccgccctgcacagatatgaagtccaaggtgcgtcagcggctcatccacccttggaagggtggcgcccagcacacctggggctttcacacgtggctcgatgtgtgccgtctgcctgccaccttccccacccagcctgacaggccctacgatagcaatgtctggcgctggctgaccgactccaatgcccacagatgcccccccacggagcaccccatcccccctccctcctggatggggcaaaacagcttcctgaccttcatccactgttatcccacgtttgtggacatgaaaaggaagaagcaggtgattttcaggacagtgaaggagttgaaggaggtggagaagctcaagttgaggagtgaggcaagagcacccccactcgatgcccagggcaacatccagccgccagcgagcttcaagaagtaccggcacatatccgctggtgggaggtttgaaccccagggcctccagctcatgcccaacccgtttcccaataatttcgccaggagctggccctgcccaaaccctctgcctcactaccaggagaaggtgctaaagctggccttgctgcccagcgcgcccctgagccaggacctcataagggatttccaaaccctgataaaggacagaactgccttacccctccaccatctctccaaggcacaagcaagcaaatccccagcaaggaagaggaagagaagacctggacacttctagaagggcttccagaggggacgatcgtgatacccagagccccaggctccagtgttctcaatcaatgctccttcagcaagaggccctggggtagcaaaaggactctggcttctgcagaacagcctctccaccatcctcccagcctcaagccacctctgtaccccaggctattggagattcaactgaaattctaaa

SEQ ID NO: 11462 - DNA, 1167 bp, Homo sapiens; identical to SEQ ID NO: 11461
  ENST00000637658

SEQ ID NO: 11463 - DNA, 2193 bp, Homo sapiens
  ENST00000587128
gagctgctgtagcccctacgtggtgagtagatcgtctccacagaaatcagcggaggcttccacagtccctggttggaatggaaccggcggtgaggatgagaggcgctgaagaccagaagacccagggcgtgaacggggcgtgtcatccctggagtttcagtagaatttcaggcctgtctgcttgagcagcagaggaggagtttctgtgtgcctgtgagagactgtgtgtgtgtgtgtgtgtgtgtgtgtgtgtgagatgaatgaacagggttgtgtacgtgtgtgtgcgttagacaaatgaacagtgttgtgtacctgtgtgaattgtcactgtgactccaggctctaggctctgcagattcctcagccctatcgcctcacagacacttgggatgtgcagcaggtaaaagagagaagccagattcatggaggcgtgaaggatcccagcaagaaaacacagacttgatcttgagacgagatttttgaaattggttgcggcctcaaggcaggctctgagaagactcgataaagagttctcaggaataggcatccctcctggatatttcccccttggaagcgccgaggagccagctctatgtttgtaaccatagcatttctaaagctccagccccaggaacctgctgtgaattagagacagattccaccctaggcatcactgatcttggcctctcttgtattgggaaggtcaacactgttccagtttctctcctactcccatctggttgtgctcggtgaagtaggtgagcagtgctacccttctgttaaaaaaaaaaaaaaaaaaaagatcctgaaagaggaaagaatttttgctacacatctgaaagctaaagtccagttgaactccagaggagaacacagcccaggtaacccctcgtttgcagcctgtgagaccagcctgaggacagcacccagctaaactccaggtccatggaaactgtgagattttatatatttatgttgttttaagctaaattcgtggtaattggttatggtagcaactgaaaattaatgcagtaagaaagtctaaggagatcggaagagactaaagagaaataacagctaaatgcaacgtagattaatgtgtgggatcctggaaaagaaaaaggacattaatgggaaaacatatttgaataagatgtgcaaatttttcgtattgtaccaatgttaatttcctggttttgataattatcctttggttatgtaagataaacgctagaatgaagggtatatgagaaccctctgtactactcttgcaacttttctctaagtctaaaataagtggaaattaaaagttaaaacaaaaaaaaaggaaaattttatctatcccaagaccacaaagttatttttctgtttcttcctccagaatctttattgtttgttttcacacttagacctatgatccatcttgaatttatatctgtgtatgtagtgggatgaagttcaaaatcatttttttcatacagatatccaagtgcactggcaccgtttgttaaaaacactggccttctcttaagctgcagtcagacttttactgtaaagcatgggcccatatatgtgcaggagtctttctacttttccgttggtcctctttgtcaatctttgtgccagcacctccattttaattcctgtagctttatattatatcttgataatctggtaatataagttgaagaacaactttgttcttcaaaatcactttgtctattccaggttctttgcattgctctataattttagaatgagttaattaattttctcaaaacaaacaaaacgccctgctgacattttgttggcagtacattgaatcagtagataaatttagagagaattatctcaaaattgagtcttacagttcatgaacatggaatacatttccatttattgaattcatctttaatttctttccttaaggttttgttgtttcctgtctaaaggtcttgcacatctgttaaatttattcctgttttacattttttatgtttttacaaactgttaaggttttaaaaattttatttttcagtagctttgctttaatataattgttttatacttttaccctttattcagcaataaattatttaatttaaagcttgtggaattaaaaaatatttttatgtacataatcatgtaatctacactatctgcaaataaagatcattttacttccttcca

SEQ ID NO: 11464 - DNA, 504 bp, Homo sapiens
  ENST00000591815
caaatgaacagtgttgtgtacctgtgtgaattgtcactgtgactccaggctctaggctctgcagattcctcagccctatcgcctcacagacacttgggatgtgcagcaggtaaaagagagaagccagattcatggaggcgtgaaggatcccagcaagaaaacacagacttgatcttgagacgagatttttgaaattggttgcggcctcaaggcaggctctgagaagactcgataaagagttctcaggaataggcatccctcctggatatttcccccttggaagcgccgaggagccagctctatgtttgtaaccatagcatttctaaagctccagccccaggaacctgctgtgaattagagacagattccaccctaggcatcactgatcttggcctctcttgtattgggaaggtcaacactgttccagtttctctcctactcccatctggttgtgctcggtgaagtagtgctacccttctgttaaaaaaaaaaaaaaaaaaaaga

SEQ ID NO: 11465 - DNA, 431 bp, Homo sapiens
  ENST00000536666
tagtagttaaatgtcatgttcgccttattagaaagaatgccttcaaatcagtattatcatgattaccatttatttaacatcttcagtatgcagggcatttataaaatctgtagaaattaattttctctaaatgcaacaagctttatgaccagcactcactgtctataaaagatgacttgcttggcagaagaggaaacagtttcttcagaccttccagccacagtcagccctggtgacattgcatatcagcttctaaagggcctcgcacattccttggcttgtgatgtcccttccccatcatcaaagacagcaacgaaacttcaggctaccatacctgcttcaactgtaggagaatcttagttctggagagttgaccctccaggcgaagcattaggctttgatacaatttgtctggtaccggctgtagatct

SEQ ID NO: 11466 - DNA, 1123 bp, Homo sapiens
  ENST00000523024
cggagcagcagagcaccgggaggcccagggatgtggcgaggcagccgcggtgtcagaaagaggaaggcaggaggctgaggccgagggccctggaatctcgcacattccagggttcagaaagatcacggtggggtccacctctggagtccacaaaagaaaacgtacaatgtggccacaggcctgcttttccaaactcgtcatggttaccatttcatgaacggcttcaagtccagaatggtgagtgcccgtggcaagtgagtatccagatgtcacggaaacacctctgtggaggctcaatcttacattggtggtgggttctgacagccgcacactgcttccgaagaaccctattagacatggccgtggtaaatgtcactgtggtcatgggaacgagaacattcagcaacatccactcggagagaaagcaagtgcagaaggtcattattcacaaagattacaaaccgccccagctcgacagtgacctctctctgcttctacttgccacaccagtgcaattcagcaatttcaaaatgcctgtctgcctgcaggaggaggagaggacctgggactggtgttggatggcacagtgggtaacgaccaatgggtatgagtagaatcctgtttccttctgaagcccttcctaattgatatacttagggccatcttccttaacaccccagacctgctggtttcggagccatcgacctcctcatttccaccgcagagggctggaggagattcagaaaatcagggcagggcccaggagaaggttctttcagagcatggcttcagcctggttacttctgacaccagccaggaggaacagacttcttccccatacagcaggtaccaccagaagtacctgagcaagatcaccctcagctcctgcagcctcagggcaccggagtgtcctgtccacggggcatttgttacggacaaagatttgtgtggcctttcactttgcacgctgaagcttaaccctggctgcaacgggacggggggccaccaaggaagtcattaaggttaactaaggtatagggtggtgccctggttgacaggatggtggccttatgaggacacttacaagatggacgcccacttgtcccccgacccctctggcaca

SEQ ID NO: 11467 - DNA, 252 bp, Homo sapiens
  ENST00000521149
atgttgtcagctctggctggaggcaaaggtttggcaattttggactggaattgacaagaagatgttccagcttctaattcccctgcttttggcactcaagggacatgcccaggacaatccagaaaacgtacaatgtggccacaggcctgcttttccaaactcgtcatggttaccatttcatgaacggcttcaagtccagaatgagtagaatcctgtttccttctgaagcccttcctaattgatatacttagg

SEQ ID NO: 11468 - DNA, 2255 bp, Homo sapiens
  ENST00000636217
atgttgtcagctctggctggaggcaaaggtttggcaattttggactggaattgacaagaagatgttccagcttctaattcccctgcttttggcactcaagggacatgcccaggacaatccagaaaacgtacaatgtggccacaggcctgcttttccaaactcgtcatggttaccatttcatgaacggcttcaagtccagaatggtgagtgcccgtggcaagtgagtatccagatgtcacggaaacacctctgtggaggctcaatcttacattggtggtgggttctgacagccgcacactgcttccgaagaaccctattagacatggccgtggtaaatgtcactgtggtcatgggaacgagaacattcagcaacatccactcggagagaaagcaagtgcagaaggaggaggagaggacctgggactggtgttggatggcacagtgggtaacgaccaatgggtatgaccaatatgatgacttaaacatgcacctggaaaagctgagagtggtgcagattagccggaaagaatgtgccaagaggataaaccagctgtccaggaacatgatttgtgcttggaacgaaccaggcaccaatggtatcttcaaggtactcacccctgcccagcctcctcctccctccagggagacagtggggcacctctggtttgtgctatttatggaacccagagactcttccaagtgggtgtcttcagtgggggcataagatctggctccagggggagacctggtatgtttgtgtctgtggctcaatttattccatgaagccaggaggagacagaaaaggaggggaaagcctacaccataatctcaggatccacgagaagccgagaagctcactggtgtgtgttcctcagtaccccttcttgctaggattggggtctcaaatgctgctggccaccatgtttaccgttgataaacctaactgctaagctttggacccaccctttttccttctctttcttctctctcctctcttcctttccattctcccacaagcatctgtggagcatgtgctgtggggtagcatctacaccagcccccagaagttagacatggactcacttctcccaaatctcacagtctaatgaaggaatgttaaacacagtgctaaaaagaggcacgagcagtgcatggggcctcccggaggaaaacaataacctccaacaaagaaggacggtttcaggaaagcattggaaactcaacgttgggaaatgacttacgtttcttgatctcagtttccttgtccatgaaaaagcagattccattagatgaactgtaaggtctttcatcacaccaacattctgtgacgcttaataacttatttctgtcatggaaggcaatattacctcatcatcattgccccactctaattccgtcagttcagtgcatgatacggacgcacacacagggaacccccatctgaggtgcaaattctttcatctcctgggccatccatgaaagaaagtctccggtagagttaggatcaggggtcttttgtccagtttgaacttgaacatggggagattatggcttgctacttatagaccacaccatcctttctctatccttaattattcaaataaaaagtataatgaggtggattggaggaagtggcaacatctgccctctccacatatgtgggtcactgagtgaggcccactgccagtcgccaaagtcatcatccagccagtgagaaaggataaaaattccagatgagaaagcagcacatcttttcactgagtggcaacaaaatagcttgtgtggccagactgaaatataagtgataagaatttgtttttagaaaactaagagaccatgtttatttaaagattggtgccatgaaggacagtcagggactggtggtagttttctgggaggtcctttcttggttatgtctacctggcatagctacaaaggagacaatcatatgtggccccataaaaaagaaagacattcagctgctcattcattcattcattcattcagatactttgtgaaacaggcactggaaagatacaggaatgtagatggtatgggtggttcatgacatctaatgtatatgtcacagccaaatttgtgcctcttctcatagggtcccctcgcaattagtaattagtttcattatataaatgcagttgtcccttggtatctgtgggaaattggttccaggacccttcttggatacgaaaatccatggatgctcaagttcctcatataaaacagtatttgtatat

SEQ ID NO: 11469 - DNA, 2149 bp, Homo sapiens
  ENST00000637190
ggatgtggcgaggcagccgcggtgtcagaaagaggaaggcaggaggctgaggccgagggccctggaatctcgcacattccagggttcagaaagatcacggtggggtccacctctggagtccacaaaagaaaacgtacaatgtggccacaggcctgcttttccaaactcgtcatggttaccatttcatgaacggcttcaagtccagaatgattagacatggccgtggtaaatgtcactgtggtcatgggaacgagaacattcagcaacatccactcggagagaaagcaagtgcagaaggaggaggagaggacctgggactggtgttggatggcacagtgggtaacgaccaatgggtatgaccaatatgatgacttaaacatgcacctggaaaagctgagagtggtgcagattagccggaaagaatgtgccaagaggataaaccagctgtccaggaacatgatttgtgcttggaacgaaccaggcaccaatggtatcttcaaggtactcacccctgcccagcctcctcctccctccagggagacagtggggcacctctggtttgtgctatttatggaacccagagactcttccaagtgggtgtcttcagtgggggcataagatctggctccagggggagacctggtatgtttgtgtctgtggctcaatttattccatgaagccaggaggagacagaaaaggaggggaaagcctacaccataatctcaggatccacgagaagccgagaagctcactggtgtgtgttcctcagtaccccttcttgctaggattggggtctcaaatgctgctggccaccatgtttaccgttgataaacctaactgctaagctttggacccaccctttttccttctctttcttctctctcctctcttcctttccattctcccacaagcatctgtggagcatgtgctgtggggtagcatctacaccagcccccagaagttagacatggactcacttctcccaaatctcacagtctaatgaaggaatgttaaacacagtgctaaaaagaggcacgagcagtgcatggggcctcccggaggaaaacaataacctccaacaaagaaggacggtttcaggaaagcattggaaactcaacgttgggaaatgacttacgtttcttgatctcagtttccttgtccatgaaaaagcagattccattagatgaactgtaaggtctttcatcacaccaacattctgtgacgcttaataacttatttctgtcatggaaggcaatattacctcatcatcattgccccactctaattccgtcagttcagtgcatgatacggacgcacacacagggaacccccatctgaggtgcaaattctttcatctcctgggccatccatgaaagaaagtctccggtagagttaggatcaggggtcttttgtccagtttgaacttgaacatggggagattatggcttgctacttatagaccacaccatcctttctctatccttaattattcaaataaaaagtataatgaggtggattggaggaagtggcaacatctgccctctccacatatgtgggtcactgagtgaggcccactgccagtcgccaaagtcatcatccagccagtgagaaaggataaaaattccagatgagaaagcagcacatcttttcactgagtggcaacaaaatagcttgtgtggccagactgaaatataagtgataagaatttgtttttagaaaactaagagaccatgtttatttaaagattggtgccatgaaggacagtcagggactggtggtagttttctgggaggtcctttcttggttatgtctacctggcatagctacaaaggagacaatcatatgtggccccataaaaaagaaagacattcagctgctcattcattcattcattcattcagatactttgtgaaacaggcactggaaagatacaggaatgtagatggtatgggtggttcatgacatctaatgtatatgtcacagccaaatttgtgcctcttctcatagggtcccctcgcaattagtaattagtttcattatataaatgcagttgtcccttggtatctgtgggaaattggttccaggacccttcttggatacgaaaatccatggatgctcaagttcctcatataaaacagtatttgtatat

SEQ ID NO: 11470 - DNA, 591 bp, Homo sapiens
  ENST00000510311
aatgaatggagggcggcggcgactgctgcagctgggccagctgcgcgggctgcaccccctcccagcctgcgagaggaggaagctagtagaagatttgtaccaacaaaaccaaggagtaaacaacttgagaataactgcatgagctcagggcttggactgtcagattccatttctaagcttccagaagagcgacacatagacactggggaagtcagagcctttgaactccaatgccatccccgtcacccacctccaccaccagcaccaccaccgaatggcactttggacaatttttccctctcatgtgacttttgtcatttcttacgtcagttggagccagcacctctcaaatccatcttctaaaacccagaaaattgtgtgtaacacatgatgactgaaagggagtaggctgaccagttaagagcctgccactggaatggaaggctgtgggaaggtgaggggacggtggacatcaaccgggaagagctgaaagatggcgttaccagaacaacttccagtaaaagaaggcactgaggtttaagtgctacgtgggagcagttgccgatttttgcaatgggaggctgcatagat

SEQ ID NO: 11471 - DNA, 539 bp, Homo sapiens
  ENST00000515288
atggagggcggcggcgactgctgcagctgggccagctgcgcgggctgcaccccctcccagcctgcgagaggaggaagctagtagaagatttgtaccaacaaaaccaaggagtaaacaacttgagaataactgcatgagctcagggcttggactgtcagattccatttctaagcttccagaagagcgacacatagacactggggaagtcagagcctttgaactccaatgccatccccgtcacccacctccaccaccagcaccaccaccgaatggcactttggacaatttttccctctcatgtgacttttgtcatttcttacgtcagttggagccagcacctctcaaatccatcttctaaaacccagaaaattgtgtgtaacacatgatgactgaaagggagtaggctgaccagttaagagcctgccactggaatggaaggctgtgggaaggtgaggggacggtggacatcaaccgggaagagctgaaagatggcgttaccaggtatctaccctgctaccctgcatagaattcccaagacc

SEQ ID NO: 11472 - DNA, 152 bp, Homo sapiens
  ENST00000514303
gtggacatcaaccgggaagagctgaaagatggcgttaccagataaggaaactgagtctcagggaggtcaagagacatgccaaagcacagcttggaagtggtccattggattcgaaggggtcctcacacgaagcaggaagtcaccctgtatct

SEQ ID NO: 11473 - DNA, 566 bp, Homo sapiens
  ENST00000443800
gcttttttgctggtagacgcacaccatcacatcctacataatatttagctctgaggcgtttccagatgggaagtgcgtttctgtattttcatagccgtgttctctacgtgaatggactggcgtgaagctgggggctgacggctggcagggcagaacaacttccagtaaaagaaggcactgaggtttaagtgctacgtgggagcagttgccgatttttgcaatgggaggctgcatagattcaaggacttccttgagtgctccaggagcttgtcattccagagacagagcagcccagaagtcctgggatttacacctctagtagaaaccctcaaccagagaaggatggaagtcaatgggcagagtgctcgggagacctttacctgttttacctgattacatcctctgaggtatgtgccatttatacctggggaaactgaggctcagaaaaatgaccttgtctgtggtcacacagctggtaaggggtaggaatggaatttaaacccagttgtctaacttcagggcccacatttcagccacaactgaggtttttcctaacctaaccccat

SEQ ID NO: 11474 - DNA, 362 bp, Homo sapiens
  ENST00000425963
cgcacaccatcacatcctacataatatttagctctgaggcgtttccagatgggaagtgcgtttctgtattttcatagccgtgttctctacgtgaatggactggcgtgaagctgggggctgacggctggcagggcagaacaacttccagtaaaagaaggcactgaggtttaagtgctacgtgggagcagttgccgatttttgcaatgggaggctgcatagattcaagtgtgagaattcgaagagattcaaagactatatcaccaccatggtcttgccagaatctgccctctgagtcatttcttaatctactgattatctgtagaaccagccttatataaacaaggaagcatctagcaggtgag

SEQ ID NO: 11475 - DNA, 521 bp, Homo sapiens
  ENST00000414314
gcccagaagtcctgggatttacacctctagtagaaaccctcaaccagagaaggatggaagtcaatgggtgaccctgcagcctgtgagaccatcttggcccttgtcagggcagccatttgccattgcagatgaagggtgggggagaggccagagactccttcagactgtgttggaaatgtcatgaaaatggaaattctcacaacctgagagtcatagacctggatttgggtttctgctgtgtcattaagttcttgcaaaccaggcaagtcatgtaacctttctggtccccagttgtcttctctgtaaaatgaagctgttaagagctctgatctcatcacgttgccatgagaaaggaataggacaaggtccaggagggagcttgcatataatgagtgctaggaaatgtcagctatcattatccttgttaatatgaacctgtgtttagtgggttgattttctgaactttgatagcagttggggtttcacggagcatttgggatgaataaacaagcatctctgga

SEQ ID NO: 11476 - DNA, 443 bp, Homo sapiens
  ENST00000514115
ggtgaatggattgtgtatgggcgtgagagtaaaactttacaaggtcgagagtcatacaaaagccaaagccgcattaaagccagtcccagccaggcttaaggagagctggaatggagaggattctcatctaacatctgggttgcagttgtatgttaacatggacttcctaggaagtaacatatcaaacaaaagggaaagtgatcaaccagcagcaggtaccagccacagttaactgcacctgctaggagctctgaaagactttttttttttttaaacgaataaagaaattctcatttcactctcctccacactggactcgctgaagaaagagctactctctgatgaagttggtggtgctgtggaagaggaccgccgcctcctggacgaggaccgggaccgctcagcattgtctgactgacaggaaaggacccagataagatcct

SEQ ID NO: 11477 - DNA, 592 bp, Homo sapiens
  ENST00000506265
aatggattgtgtatgggcgtgagagtaaaactttacaaggtcgagagtcatacaaaagccaaagccgcattaaagccagtcccagccaggcttaaggagagctggaatggagaggattctcatctaacatctgggttgcagttgtatgttaacatggacttcctaggaagtaacatatcaaacaaaagggaaagtgatcaaccagcagcaggtaccagccacagttaactgcacctgctaggagctctgaaagactttttttttttttaaacgaataaagaaattctcatttcactctcctccacactggactcgctgaagaaagagtagctggctggaggaagctatccagagggaagcagcacagcatctatgcacagacatagcaaataagagcaagtgaaccacgccacacttacgactatgtcaacaaaggaatagaagcaaaggaaaagactgacatagcttagactgggaatccttctagaaagtaagaaagaattcagagagattcctctctctagtcttgaagaaatgaaggtcttcaaaatgaagattgaagaaatatagaatatctaaaaaaaaagaaaga

SEQ ID NO: 11478 - DNA, 1361 bp, Homo sapiens
  ENST00000512624
gttaaatggccagcaggaattatccactagagaagcggaagggagagaatggaaatggccgcatgcagctcctctccctcagacagctcggggctcagcggaatgagcacagtctgcaggacaagtgcggaggacttcagtcccctctactgtatattggctttaggactcaagttgtccctgaaatagaggaaggtgttttctagggtagtggtaattatcacagtcaaaaaagtaggcgagagcacttaggaaaactgtgcggagatcggctgctgatgtgtaaatactgctgaagctgcttattcaagattagaaaacctgagacccagacgggggaaactgctttccatggttaatcgtcaacaactggccaggatgggacagaagcccatacatagccttcattccagggctcagaacaaaaagaaggcagtggcctgggctgcacctgagcttggcttcacataggagggattctggaacgcaggatcctgacaacgacctcaagcccctgtaaagcaacacattttttggcaagaatccctgggacagagaaagaatttcttctcacttattattgagaatgttctcatgtcttgcaaggctcactgcccagtagaagctgaaaagattcagtatgagtaaaagaagagatctgaaatttgcagcttgtcatagaaagaactgagactaccatacacctaagaagtcaaagttgctattcaaggggaagtgcaaacacaagatgagggaaactgatgtatttagtgtctacattttacaaatggatgcttttcataatatgaaaatactgcaccataagattgccagtcacaacagcacggctacagtgaaaattgtcagtcttttttttttccaggatcccagtggatttgttacggtgagaaagcttcacttggagacaaagccaaaaccttcctcccaggctcccttggatgtagggggaagcaaactggctgtccaggcctctgagccacatctacacacctcatgagagggcctgtgcaacattgccttagagatggagagcattgcttcagaatcagggaagcctaaatttcacccctggggctgccccttgtgatcttgaatggctcctgacaagaggctgctggggaggctcctgctccctgcctttcgggactgccgtggattgcccattgatgggtcaaaatccagctacctggtaattcaatgagtccctagtgtgcatccaataaattatcttctgtttaaattagaacaaactgtttttaatctgtgtgctaagaatctcattaaatgcatcataaatttcaaaatcaaaaactaaataaaacatttatctatcgagtact

SEQ ID NO: 11479 - DNA, 689 bp, Homo sapiens
  ENST00000540244
gagtgttaaatggccagcaggaattatccactagagaagcggaagggagagaatggaaatggccgcatgcagctcctctccctcagacagctcggggctcagcggaatgagcacagtctgcaggacaagtgcggaggacttcagtcccctctactgtatattggctttaggactcaagttgtccctgaaatagaggaaggtgttttctagggtagtggtaattatcacagtcaaaaaagtaggcgagagcacttaggaaaactgtgcggagatcggctgctgatgtgtaaatactgctgaagctgcttattcaagattagaaaacctgagacccagacgggggaaactgctttccatggttaatcgtcaacaactggccaggatgggacagaagcccatacatagccttcattccagggctcagaacaaaaagaaggcagtggcctgggctgcacctgagcttggcttcacataggagggattctggaacgcaggatcctgacaacgacctcaagcccctgtaaagcaacacattttttggcaagaatccctgggacagagaaagaatttcttctcacttattattgagaatgttctcatgtcttgcaaggctcactgcccagtagaagctgaaaagattcagtatgagtaaaagaagagatctgaaatttgcagcttgtcatagaaag

SEQ ID NO: 11480 - DNA, 563 bp, Homo sapiens
  ENST00000546062
atggaaatggccgcatgcagctcctctccctcagacagctcggggctcagcggaatgagcacagtctgcaggacaagtgcggaggacttcagtcccctctactgtatattggctttaggactcaagttgtccctgaaatagaggaaggtgttttctagggtagtggtaattatcacagtcaaaaaagtaggcgagagcacttaggaaaactgtgcggagatcggctgctgatgtgtaaatactgctgaagctgcttattcaagattagaaaacctgagacccagacgggggaaactgctttccatggttaatcgtcaacaactggccaggatgggacagaagcccatacatagccttcattccagggctcagaacaaaaagaaggcagtggcctgggctgcacctgagcttggcttcacataggagggattctggaacgcaggatcctgacaacgacctcaaggcagtgaactccaaatttgaccaagacgcagcctttgtcctgttatttttataacctccaagggaggacacggcgcctgtggaggtcatcattttgatca

SEQ ID NO: 11481 - DNA, 1184 bp, Homo sapiens
  ENST00000420725
caccatataagaagtgcctttcaccttccaccatgattctgaggcctccccatccatgtggaactaaatggaatctttctctgttgcccaggccagagtgcattggcaccatcacagcaaagtgcagcctcaacctcctgggcttggctaaagcaatcctcccacttcaacctcctgagtagctgggactgcaggaatggggacaaagctattgaaaacttctccttctcaggctcacttcgccaacatctgtggctgaatgtagacattcccccttttaggcaaatttctttaaattcatagcaaggtatgaccaagaacattaaaacaatgcttcattgcttatgcctgacgttgaagagcaaaatttacatctgctacacagttcaaggtttccatggccttagtagaggtcatgaaatgtacagttttaaaacttattggagtatctttatgaacgattttaatggactagagtgacaatatttttatacaacattgacctcccctgccccaaatgatgtgaaagactgtggctgtattagaatttagtctagtaagaccaataccatttcagggagttttttgtagttttcctccataaatatattttccacatcaactgctctgagctgagttgctggaacattttcaattctttataagtacatattttggctgagttcagaaaccttggactaggcactgtcctttgagtgagacgtcaggattgaggtagcataggcacaagaccaaattttagttcatgatggagtattgccagcttgtgagcctctggtgctttcaaggaagcacaggtgatggaaatcaaataaaaacagagccaggaaaacatctggtgtggaaagtagctcattgcataaaatgctaaaaacaaaaagttgagaaaattaagcctcttctactttttaaaagaaaaatttgactctaccaattataaccacaaggaatgttctccagacttgaatattttaagtgaaagattaatatccagccatttataaacctccaaatcctttccccaactttattcataccattttttattataaattttcaaaaaatttactgatctagtttggaaaaatcatgtccttgaactgttgaaccatatttgtaatctgtttcaataaaaatatagatataatacttagaaaaacaga

SEQ ID NO: 11482 - DNA, 2198 bp, Homo sapiens
  ENST00000512279
aaagcgcttgcagccgggagctgcgcggccgcgctgagagtcacgtggtgcgccaggaagccgcctagcttcttggagagctcactgcctcgctccgctcctttcctggcgggaggctctgagccacccccacctgcgcagggcggccaggggttaaaacaaagtcacaagtctgacccacactcaaagggagaagattatgcaagagcaaaagcacgagatggaaaccatggggccatcttatagtctgtctgccggagaaagatgaacacaaatcctgtgacaccaggtggagggtgactatggaacatggaacacacgcagtgtaataatgtaggagcagagtcctccattctcctgtgacacccattcccattatacacttagaacctccaagcttgtgcataattatcaatggataagagacagaagaagcaatatacacagcatctgggaggctcctaatccacagataaggcttcctaagcttcctttcctatgctagacatattttggtgatggagtatgacaagcacacgggacacattagccatggaggctgctgagttctggagttccactagacacatggtcttgctgtggttatatgtataacttgcatgcttcagctcagcttcccatgattttcaggataatttaatatgagcagtctaaatagaccaggacgtaatgctgaaatgatttctagatcagtagtcagcgcgtagccaaccctttcaggaccctcatttgtcttctatgttagtgtattccatcagtcgatatttgcaaagaattctgttcagagtcaaaacttcttcagagatccctaaggagggaggaataaattacaggcccatggttactctttcatataatatctaaaaggccattatgtgaaaagattgtctctgaaatctaattcttgcctcagccaggtcaatttaggaaaactgcactggcagcagccagctctgtaatgctgcccaagcagataaaagcttgtagatttgaataaggcccagaccgcgcttgctgcctctgtggaaacagatgttttcctgtgtgaaaacagccacttgcctatggacaaagctttttataagctggtcgtggacacagatgtcttcaattttttttttcactgtaatgatactgcagtgaacagcttctgagatggcccctagcaatcctgcctccacatccaggcctttgtcccttccctgtgaatgggtgctggctgagtagtttgtttcaaaccagcagaatatggcaaaagttgtcactcccatgattaggttacatgatatagtcgagtagaatgtattcctttgctggctttgatgaggcaagttgttttatcaggaaggtccacatggcaagaaactgagggcaacctctgaccaacagccagctagaaaacgaaccctcaacccaacagctcatgggaactggatcctgccaatgatcatataagtgggcttggcagttgatcctttcccagtcaaaacttcagacaagaacacaaccctggctgacaacttgattacagcctatgagaaattctaaaggagagagcccaggtaacactcatagaaactgtctcattggccggatgcagtggttaacacctgtaatcctagaactttgggaggccaaggcagaaggattgcttgacaccaggaggttgaggggaaggagtggctttgggtataagtgcaatttaggctgaatcctggaggaaacctaacgttcctttgaaagatttgaggtttataattaaaagcagagattccatagacttggcaatttaaaaataccagatgttgcattgtgagcaggaggatatcagttcagcacctctaccccccaaaaagaaaagaaattcagggagggagcaaagaaacattcctaaaatgaattggagctggaggccattatcctaagtgagttaatgcaagaagagaaaaccaaatactgcatgctctcatttataagtgggagcttaacactgagcacacatggacataaacatgagaattacagatactatggaattctagagtggggagggagggagggagggagcatgggttgacaaactacttattgggtgctgtgctcgctacctgggtgcaatatgcctgtgtaaaaaaactgcctatatatgccctgtatctaaaataaaagttgaaatt

SEQ ID NO: 11483 - DNA, 2643 bp, Homo sapiens
  ENST00000518662
aacactcaccaggaagttgatgtcggccgggcgcactaggcggtagctgcacgtcgcgcaatcctggctgcattcggcccgcacggtcgccaggagcccggggccgagcaacagcagccaagtgcaaagtgtcaggaaccgcgccatggactgcgaggagagagggacgcgtgcttcgagcctgcctgggcgcagaacggggtccctcggcaggaccctcgccgcgacagcctcagcaggggatcgtcgagcaaaagcccgcaggaatgctcctttctggggccccgccctcccggccgacagcttttaggtagacgtggaggcgactcagatcgcctcgcggttcccgggatggcgcggtcgcccccaacgcgaggctgcctggggcacccggctcttttcctgggcgtccgcggcccagggcaagattccggagagaacgccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggaagctgaactgacacgaaacaaaagaagtccgttgttttggattgagttccatacttggctggcccagaggttgatctcaccaccattcagatatccaagaagaagccacctgttggatttaagaaaacccagtcaccaataatgtggaatccatttcgtggagacaagctacttttagtcaaaaattgtaaggcacggtttgtcaagatggccgatacacaacagctccagtctacgcatcccagcatgagcgatgcagaagacgggtgatttctgcatttccaactgaggtaccgggttcatctcactgaagcttgtcggacagtgggctcaggacagtgggtgaagcccactgagcatgagccgaagcagggcgaggcatcgcctcacccaggaagtgcaagggatcagagaattccctttcctagccaaggaaagctgtgacagatggcacctggaaaattaggtcactcccaccttaatattgcgcttttccagtggtcttagcaaacaacacaccaggagtttatatcccgcgcctggcccagagggtcccacacccacagagtctagctcattgctagcagagcagcctgagatcgaactgcaaggcagcagcaaggctgggagaggagcacccaccattgctgaggcttgagtaggtaaacaaagcggctaggaaacttgaactgggtggagcccactgcagctcaaggaggcctgcctgcctctgtagactccacctctgcagccagggcacagctgaacaaaaggcagcagaaacctctgcagacttaaatgtccctgtctgacagtttggaagagagtagtggttctcccagcacgcagctggagatctgagaatggacaaactgcctcctcaagtgggtccctgacccccaagtagcctagctgggaggcattccccagtaggggcagaatgacacctcacatggccgggtacccctctgagacgaagcttccaggggaaagatcaggcagcaacatttgctgttcagcaatattcgctgttctgcagcttctgctgctgatacctaggcaaacagcgtctggagtggacctccagcaaactccaacagacctgcagatgaggatcctgactgttagaaggaaaactaacaaacagcaaggacatccacaccaaaaccccatctgtacgtcaccatcatcaaagaacaaaatgataaaaccacaaaaatggggaaaaaacagagcagagaagctgaaaattctaaaaatcagagtgcctctccccctccaaaggaatgcagctcctcgtcaacaatggaacaaagctggatggagagtgactttgatgagttgagagaagaaggcttcagacgatcaaacttctccgagctaaagaaggaagatcgaacccatcccaaagaagctaaaaaactttaaaaaagattagacaaatggctaactagaatatccagtgtagagaagtccttaaatgatctgttggagctgaaaaccatggcatgagaactacgcgatgcatgcacaaacttcagtagccctgcaagagctcctgagggaagcactaaacatggaaaggaacaactggtatcagccactgcaaaaacatgccaaattgtaaagaccatcaaggctaggaagaaactgcatcaactaatgagcaaaataaccagctaacatcataatgacacaatcgaattcacacataacaatattaaccttaaatgtaaatgggctaaattctccaattaaaagacacagattggcaaattggataaacagtcaagacccatcagtgtgctgtattcaggagacccatctcacgtgcagagacacacataggctcaaaataaagggaaggaggaagatctaccaagcaaatggaaaacaaaaaaaggcaggggttgcaatcctagcctctgacaaaacagactttaaacc

SEQ ID NO: 11484 - DNA, 568 bp, Homo sapiens
  ENST00000522511
tttataaaagtatggcacctcttccctctctctctcttgctcttcttgccatgtgacacctcgcccttcaccttctgccatgagtaaaacttcctggggccttaccagaaatcaagcagatactggcactatgcttgtagagcccgcaaaactgaagctgaactgacacgaaacaaaagaagtccgttgttttggattgagttccatacttggctggcccagaggttgatctcaccaccattcagatatccaagaagaagccacctgttggatttaagaaaacccaatccctgacttacaccctgacttgtaatctggaaccacgcagagattttcaatgacaatgtggggaaacagaatttgtctgaactttggtgattttgaatgaagtttatataataattaaagccagggcagatttggcagtcttcttgaaaggaagtaatgcttattgtggtcagaagaaagagtgaggcaactcagggtctgaaaaaagagacatgaagaaagctgaggaccaatccattccaaggttcactgtggaaatggggcccaacccttaaaaggt

SEQ ID NO: 11485 - DNA, 337 bp, Homo sapiens
  ENST00000443448
cctggaagagtcctcccttccaccccggatatcactgtgaacctgattccccaggatcaaccatctgagcagataccttggaatgtccccagatttcagagcctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacagggca

SEQ ID NO: 11486 - DNA, 337 bp, Homo sapiens
  ENST00000412221
agtctgtcaacttgggcgtgcaaacaaccatcctaagagcctttcttgctctgatagggagaaaaaaaggcttcgggggctaccagaggagaagaggccatcacctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacaggg

SEQ ID NO: 11487 - DNA, 362 bp, Homo sapiens
  ENST00000431307
gcttggcgaactccttgaggacatgggctttgttttctgttccattttaccctccactgtgccttcgcagggattccccaggatcaaccatctgagcagataccttggaatgtccccagatttcagagcctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacaggg

SEQ ID NO: 11488 - DNA, 473 bp, Homo sapiens
  ENST00000502645
actagagttttgctcctgggacgggacgtccgagaggtctgctggagtttgctggaggtgcactccagaccctgtttgcctgggtatcactagcggacgctgcaaaacaacaaagattgctgcctgttccttcctctggaagctttgtcccagaggggcactcactagatgccaggcagagttctcctgtatgagcttttggttccagagggccatagtcttcatatacttcagcactccatgaaggctttcttggtactgttcaaaggccagaggatctactaccacagaaccattctagatgtgagttcctagtgtgaaaggactgggagttaacagaagagccacagtgagagtctccacctgactgcattgcttcatggcactgtgcttttggacatttgatatccttcagctagaatatatttcttcattgtccattcacaggagccttcctttcttaaagactcaat

SEQ ID NO: 11489 - DNA, 581 bp, Homo sapiens
  ENST00000511775
ctagagttttgctcctgggacgggacgtccgagagcttttggttccagagggccatagtcttcatatacttcagcactccatgaaggctttcttggtactgttcaaagtaagatataacaagttgctgtgttgcatacatctttacaccttcattgcttgttctcccaggcatgctatcatacccaaggccacatggtgagatggaaagacactgcatctgaagtcaagggaccaaggtttcaaattctcaatgtcccccttgcatgatgggcaactgacatatcactccgcactttgcttgttgatttcttcattgagtgacagtaaaatggttgagtctgttcccagctgtcagactgccaggaatatctagtagtttggtttcctcttctggaaaatgacattagtagttaatgctacagtgtttactttgtgccaggccatttcctaagtactttacatatatatttactcttttaagtctcatgacaaccctatgaggtagtgtgttagtacattttgcattgctataaaggaatacctaagactgggtaatttataaagaaaagacatttatttg

SEQ ID NO: 11490 - DNA, 575 bp, Homo sapiens
  ENST00000513158
aaagtaggaaagaatttagcaaagatattgtatcaggaaaataaaacaaaatcactccagttattttaacagacaaaacgtcatataggaagttggtgttagaggtctgaaaaggcaagtaggaacatggacataatatggagaaagtgagtgcagccttcacctctagggatgggagaaacacagggaagaagctggggtcattagaatccagaagtttagaggaggagtcttttcaagttaaactcaaacttcccaggagaaggcagctgattagttggcactggtgtttctgtgggtgtatgaggaggaggcttctgcaagggagaaaaacaactggaaactggaacaacgcaggctgccagggcgaaaatgcactgctgggtgatgctgcaggaacaggaaacaaacaggaaggactcggtcacttcccttttctcgagtttcccgtctccctctagcaccctttggcagagtctagcatggcaccatcaggccaagctgaaacgtggtttgcagagagccagccccagcatcacagagtctccacctgactgcattgcttcatggcactg

SEQ ID NO: 11491 - DNA, 957 bp, Homo sapiens
  ENST00000601106
aactagtcatgcgcctcggatgccgccggccacggggctcccggaggggggtccgacaccgcccggtgcccgggatccccaatctggccggtggatgaggccccatcccatgcacccgagtgcgggggacgggggggttaatattaattcaggatcccatccccacccgaggcaggacacccagtgcacgccccaactccgggacgcgggctctgaccctggaacttccgagattcccgcgacgccccctgtctctgggtccagaacttcgggggacacctcttctgcctcctccaaccccagagatggggtgtcactatgttgcccaggctggtctccaactcctggactcaagagatctgcctgcctcagcctctcaaagggctgggataacagatgtaagccactgcatctggcctccaatgagttgttatgtgaagagaacgtgattaagttagaggactccaaccaggcctgaactctcaaggacagaaatgggtccaacctggcatgacatcctctaaatctttagctcctggcctctcaggtgccccctccagctacctccctcttccttctcttcattccccaagccatagctggttgggccaacctccagacattagcctctttgcaaactcctattcatccctcaaagcctcaccttcaatgctctcctccccaagaagctctctcctctacctctagaccttttccagccctcttccctctttctggcccagccctgactcctgggagtgtctgtgtgcagctttgactcccccagcctgagtgtctctcaagggctgagaccagggcccatgtttccctagagtttgtcatcttccagcatagtgtggacgcatgggggtcaggcaaagggggagtttgatgactcagtactattggtgattttgcatcacttgaaggagaccctgccttaaattcagaacttga

SEQ ID NO: 11492 - DNA, 573 bp, Homo sapiens
  ENST00000523191
gaagatgctggagactttgttgcaagaaaggatggctttaggtcatgttgctgaggcctgatcttaaagatctaattgctattggaagagaatcctgtttcccaactgggcctcccctctggagatggagcaaggaagactgtccaactctgctctgggcaccctgctgatggatgaggtgtcaggccagtcgtcatgtgaggactggtttccaaatgcagatacaaaaagaaaaattactgtcatgtgatgtgtgatccatgataccgtcatagttttgttttgctgtgctccaccttcataccttcgcctatgttagaacttctgagaagctgaagcatcacatataaaaagccaagaccatcctcaaggagtttaatgaatgtggcatcacaagaaaaatatgcatcaacattgaaaagaaaagaaataaaattccattaacagagcttgaggaagtggacttgactaagctggagtaaggagtgcagagagtgaggagacaggatgcgaaacaagaagatgaggaaactgaagcctgagaacaacatgaattctacaatacatttaccg

SEQ ID NO: 11493 - DNA, 581 bp, Homo sapiens
  ENST00000524360
agtttgatctcagactgctgtgctagcaatcagcgagactccgtgggcgtaggaccctcctagccagatacaaaaagaaaaattactgtcatgtgatgtgtgatccatgataccgtcatagttttgttccaagaccatcctcaaggagtttaatgaatgtggcatcacaagaaaaatatgcatcaacattgaaaaatatggtgcctccctctggaacagagcgcagttatatttcctgcatagtatggaaaagaaataaaattccattaacagagcttgaggaagtggacttgactaagctggagtaaggagtgcagagagtgaggagacaggatgcgaaacaagaggtcccacaataggctgtctgcaagtttgaggagcaaggagagccatcccatgtctcaaaactgaagaacttggagtccgatgttggagggccggaagtatccagcacaggagaaagatgtaggctgggaggctaggccaatcttgcctttcaagtttttctgccggttttatattcacttacagctgattacattgtgtccaccagattaagggtgagttggtcgtccccagcc

SEQ ID NO: 11494 - DNA, 579 bp, Homo sapiens
  ENST00000521958
gaagatgctggagactttgttgcaagaaaggatggctttaggtcatgttgctgaggcctgatcttaaagatctaattgctattggaagagaatcctgtttcccaactgggcctcccctctggagatggagcaaggaagactgtccaactctgctctgggcaccctgctgatggatgaggtgtcaggccagtcgtcatgtgaggactggtttccaaatgatgagaaaactgaggctctgagagatgacatcataaagccttgtaagacccagttgctgtgctccaccttcataccttcgcctatgttagaacttctgagaagctgaagcatcacatataaaaagccaagaccatcctcaaggagtttaatgaatgtggcatcacaagaaaaatatgcatcaacattgaaaagcaaagccttccagccagttcaatggtgggagtctccccctgctcttcctgcacaatcatttcccattgaggaagaatgtgaaaatgacgcacaggtgagggaggcatactataagaccgcttcttacctttcgtttcctggagccaatatgaatgaagacccagagag

SEQ ID NO: 11495 - DNA, 569 bp, Homo sapiens
  ENST00000520365
atgcctcaccctgctttggctcgcgcacggtgcgcgcacccactgacctgtgcccactgtctggcactccctagtgagatgaacccggtacctcagatggaaatgcagaaatcacccgtcttctgcgtcgctcacgctgggagctgtagaccggagctgttcctattcggccatcttggctcctcaggcaacctcttttctttataaattactcaatctcgggtatttcttcatagcagcatgagaatggactaatacaaagtcctttggctggaggcaacaggaaaaattctgactatcatttcccatgctacccctcacctttcaaatcctttacaatatggggagcaggagaaaggcagatcttacttgagaggaccgtgaggggagcaaggtcgagagtccacatggaaccccaaaaactaggagagctagaacaaggacatttgatacaaaaagaaaaattactgtcatgtgatgtgtgatccatgataccgtcatagttttgttttgctgtgctccaccttcataccttcgcctatgttagaacttctgagaagctgaagcat

SEQ ID NO: 11496 - DNA, 200 bp, Homo sapiens
  ENST00000505607
atacctgaaggcagagggcgaccctttgacgtctcagggccatatatcagttccctaacagtgaagcccacaacaagcaagaatttctgacatgacatgggaaaagctgaagaagtcagtctttggggtgtgttttcatctaggaggtggcttgagatggattcatggcaaatcacaataaattatttatcagataataa

SEQ ID NO: 11497 - DNA, 282 bp, Homo sapiens
  ENST00000511951
ctgctgagcccacagagtagctgggattacagatgcgtgccacctcacccagttacatcttcctgaggatagagcctacatagaagttcagcaaatatctggtcttttccacacctgggaagatgtgggtataggccactatgtgttttcctttcaaaatggcaagaatttctgacatgacatgggaaaagctgaagaagtcagtctttggggtgtgttttcatctaggaggtggcttgagatggattcatggcaaatcacaataaattatttatcagataa

SEQ ID NO: 11498 - DNA, 421 bp, Homo sapiens
  ENST00000507038
aggtgaaagaaaactaaagaaataccagtgcagaaaggaagttctttattttcaggttgctcaagctaaaacaataagcagcatttcatggatgactggcatgtcgccttttactcctcaaggcagactcaagagttttcccagaaacagaggacgagccccttggccatgcagccctaagccaggctgatccagccttgtctcgcccctctctgcaagagactcgtgggtacaggatgattgagggggccccagcctccccagcagctgctgacttgcgcttggaaattcaatcctctcaaggcaagaatttctgacatgacatgggaaaagctgaagaagtcagtctttggggtgtgttttcatctaggaggtggcttgagatggattcatggcaaatcacaataaattatttatcaga

SEQ ID NO: 11499 - DNA, 385 bp, Homo sapiens
  ENST00000421256
agacggggtttcaccatgttagccaggatggtctcgatctcctgacttcgagatccacccacctcggcctcccaaagtgctgggattacaggcatgagccaccacacccggcgactcattcttatacaactacctttgtcagcattcttgccattggactgtctagcccttgatgctgttatatcatggcttgttgatacagaagatgctacatgaactcaagtggaactctgactgccttgagagcatcccaccatccattgctgctgcatcaaggtattaaaaagagagacagaaggaagaggtgagagaagcacaagtttaacagtgtgagggcattttgcttaataataagacatttcattaaaatattagctacttttgt

SEQ ID NO: 11500 - DNA, 606 bp, Homo sapiens
  ENST00000429070
agagacggggtttcaccatgttagccaggatggtctcgatctcctgacttcgagatccacccacctcggcctcccaaagtgctgggattacaggcatgagccaccacacccggcgactcattcttatacaactacctttgtcagcattcttgccattggactgtctagcccttgatgctgttatatcatggcttgttgatacagaagatgctacatgaactcaagtggaactctgactgccttgagagcatcccaccatccattgctgctgcatcaaggtattaaaaagagagacagaaggaagagaatgtttgtcaaatgtcttctttgggcacctcacagggccaggcacaaggggaaggggtatttgcagctgacttcaatccaaagctgaatgtggatgttggcacctgctgctccctctctccagacatctccctgtatctttgcttatttggtttcatatttattgaccatcaaccaccccccatccctgtagaacgagaagctcatgagaacaggggtcttgttctctagcttttgtttctccaccgagaagagtgcctggaaacagagtcaatgctcaataaacatttatggaacaaa

SEQ ID NO: 11501 - DNA, 464 bp, Homo sapiens
  ENST00000512976
catgagaacacattgcctcatacttgctgcaatagagttgaataagtaacagcttttaaattggattatcaactcacattgctaccaaatacgagcatatcaatagcaagtcatttggggtgaatggatatgttgactgccacacctgggtttctgtgactactcctggattcagtgatggagtcagccccaagtcttgtcccatctgttccaagctatttgtccatgtaaaactgtcaacgttccaagccactgactgacagggtaagaagagtgagtctcaagagagtgaggaacggtgaatctttggcagactctgtgtgtgcccatggaagagacagtgacagaaattatgtaatgaaaaaaatgtagcacaagccttatgaatttttacttttcactccatgggattcccatatcaaaagacctattctacacaaaataaagttctctatgaagaattg

SEQ ID NO: 11502 - DNA, 1847 bp, Homo sapiens
  ENST00000511616
gagagtctggctggaggccaaacaacacaaaaccagcacacttaacaaaaatataaccaatgacccttgcagagtccacttaactcccctccaccagagcaggtgctggtatccacagctgagagacctgaagatggatcacatcacaggactccttgcagacattctccagtaccagcccagagcctggtaggtctgttgggtggctagaccagtattctaagtgaagtaactcggaaatggaaaaccaaacatcatctgttctcactcatcagtaggagctaagctatgagaacacaaagacctgtccacgctgagtttatagcaactgtcaattacggttcagattttcctaccccagcgtgactttccaaagaggcttctgctcatggatttctgctccaggaagatgcaacaggaaggtcctcacaagatggctgaacagatgcaggtgctgtgcctctggactgcctagcctccagaactgatacatatgcaggatgtgcagctttgttacacagtatgaagcatgtctttaggactttctgtgccatctggtatccatcaaggggagagtcccaaactgcactggaaggcatcttccagatggtggtgggcgctaaagatcagctgtgtgggtgtgagcttcccatgcctgtggagaagcagcaattgaattgctcatctggaatgaagtttcgtggattttttttttttttgaacagatcactgactacttccaatatgcaataccaagtaaagactgcaaatgactgtgccacagggaggaaaagcagtcaacctgtctttagggacctgttcaaatttctggtgtctcagtggatgttgatttctgacataaagccatttgtgcacatgaggaagatactgtaggaggcatttgctgtgagccagtgtttggtctttagctgaaacagacatttagccataaaccaccaaccagaaagatcaataagacacggttcctcttctggtgggccacataaaggaagttgtcatgttccaacttaatgtgtgggttgagagggatctgcacaaacgagcgtcatcggggagaaaaatatatcccagtctgcgtggtcacggggagcttcctgggcaagcaacatctagactggtgtttgaccaaactactgggcaccataccccagccaagtcagcatataatgtgaaccatcacagtgggagacatgtcacaaagtggtaagacagcaagaattggtggtctgggctggattccagagaacctggactgtgcctatgaagcaccactgccctgtagacctgggataataaacactgatgcctaaagggaccaggcaggaactccttcatagatgaatgcttggtgttattcattacccagtcttgagggactcactggtgagctcggggctcagggagtagacctgactggggagctaagtgatctcgtgtgactctctatgcctcgttgccaccagcgtgggccatctccaggggctctcaaaccgatagaagaccttgcggtgtgggaaaacagctccagagcttctaagctgagcggattgttcctagtgaggaaggtcttgtcccatctgttccaagctatttgtccatgtaaaactgtcaacgttccaagccactgactgacagggtaagaagagtgagtctcaagagagtgaggaacggtgaatctttggcagactctgtgtgtgcccatggaagagacagtgacagaaattatgtaatgaaaaaaatgtagcacaagccttatgaatttttacttttcactccatgggattcccatatcaaaagacctattctacacaaaataaagttctcta

SEQ ID NO: 11503 - DNA, 236 bp, Homo sapiens
  ENST00000606744
ctatgaagcaccactgccctgtagacctgggataataaacactgatgcctaaagggaccaggcaggtcttgtcccatctgttccaagctatttgtccatgtaaaactgtcaacgttccaagccactgactgacagggtaagaagagtgagtctcaagagagtgaggaacggtgaatctttggcagactctgtgtgtgcccatggaagagacagtgacagaaattatgtaatgaaaa

SEQ ID NO: 11504 - DNA, 429 bp, Homo sapiens
  ENST00000606222
ttctgttttctcctttccactaagggaagatgcaacaggaaggtcctcacaagatggctgaacagatgcaggtgctgtgcctctggactgcctagcctccagaactgatacatatgcaggatgtgcagctttgttacacagatacttttggctcggtgaatggtgcttatcagttaacagcagaaaccctcctgaaatggaaaatggttcattgtttccatcatgtactctatggaatacaaagctctgaaacctgttggctactggaagtgtacaagaaaaagactctcaagctagaggtggggtagagctggagccagccatgtcaagatctttcgaggacatgaacattttttatgcttattaaaagatgatgtggttttaaaataaatctaaggctgggcgcagtggctcatgcctggaatccca

SEQ ID NO: 11505 - DNA, 419 bp, Homo sapiens
  ENST00000606169
ggcttctgctcatggatttctgctccaatgcaacaggaaggtcctcacaagatggctgaacagatgcaggtgctgtgcctctggactgcctagcctccagaactgaggtgttggaagctgtgaatgtggatgaaagtaccaatatagagagaacagagtgagaatagaagacagcccaagaatctaaagtcatgcacttgcaagggagtcagaggaagagaggtaagaaggaaaatggttcattgtttccatcatgtactctatggaatacaaagctctgaaacctgttggctactggaagtgtacaagaaaaagactctcaagctagaggtggggtagagctggagccagccatgtcaagatctttcgaggacatgaacattttttatgcttattaaaagatgatgtggttttaaaat

SEQ ID NO: 11506 - DNA, 1978 bp, Homo sapiens
  ENST00000502521
caaaagagcaagtcagggaactagctttggttgggttcggtggtacacaaagcacaaggcctgggttggggttaggaggaaatgagacttgcggcgggtcggggctgaagatgtggcagcgccctgaacctggagaaaggctgaatccctttggtcaaggagagggagagagaggtaagggtctggtcttactttttaagcaggaagaagactacaaaccaccatctaccatctgccaggccctggaatttgaaccaccatcttctggagtgactcaaatgcagaggaagccaggcctgctgctaacgtttctgagaggcggcaagagtataaatggagatccacatatgtataaataaagagtgtgaatcaagctaacaaactgtttaataaaatatgatctaccctcttagcttgacaaatcaacttttcaaacacctggaagaacaagtttgcactcaggattctcagactcctcagagttctgcactgggatgtggaagggctgtgcaagccagcccttgggtccctgatccctgtctcctggcctgtgcccgtctcttctcagcctggctccaactcccattgagaggaagttcttgtacacatatgatactgcagcccttatgtctaatatttatccataccttctgcaaacagccactgtgtgaccacccttgggcttcccaggggtctgcaaactgacaatacagacaaagggaaccaaggcagaggctcacagactgtagaaatgggcttggggccatctgggcagagacttgtggaatcccagcacgatcactctgggtgctgtgtgaaatggatgaatagcaaggagctgcagccaagagcaaatcaacagaagcaccactcaaaatgcctcagtacccattacataaggattcttgtgattaattcttccccaaaatttagagccaagaaaaatccagctctcctactgagagttgtagattagagcttctgtttctaatctacaaacaaacaaatgtgtgcaatgtcttttcatgacaattccaactttatcataaggttgtctactaagaaactagtaggcaggtttctcttgttgtctagaccacctgaaagctcatagctgagtttgcacttatttgcagagtaaactgctcatttatcaatctggcatccaatcacaactttttagctaactgtatgttttcataaacacttttctcacacagtataaattttaaataaataacaatagcaattaagtagtaacaactcgagactggtatctgactagtggttctttcaccagtgtgtacactggaagttttgttttgttttttgatgtttgtacattgtaattgcaggacaggtagtaagaagatttcaaattcacattagctttgctaccactaaattatggtgactgttcctaatttgcaaacaaatgtatgcaatctctttttatgattatcccaactttatcataaggttgttatattttaagacatatgaaaagatataaagtataatacagtgaatacatatatatctaactcccagtttaagaaataaaacattagcaaatacagctgaagctccatgaattcccctcccaaatcatactcccttcccacccgcagagggaacctctattctgagcctggtgtttatcaccaccaagaattaaaaaaatacttttactatatatacacaagtatgtaccccttagaaatgagtagtagtactgttttgtatgtctttacactttaagtaaatggtataagttatttcttgtttttgctcaaaattgttgaaatttatgccctttgattctatagctgactttcactgtgagtcattccatcattatttctgtattcattctcctgctgaagtacatttcaggttgttgctattcctctgctgatccccctcccccaacacacatgcttttattaataaatctgctggaacattcttgcataca

SEQ ID NO: 11507 - DNA, 2189 bp, Homo sapiens
  ENST00000511699
gcaagatggcccttaccagatgctggcaccttgatatttgacttcccagcctccagaactgtgagaaacaaatttattttctttataaattactcagattgtggtgttctgttacagcaacacaaaatggactatgtgaagaaaaccatgttggaatcttgtgctgtcattgataagaaaggatctgagcattaggtcaatcaccaaaaaactgaaaaatcagtaacaatgatgacagactcttcaaataggatgatttaaattttaggaaattggaagaagactccaagaaacttaacaaggtcctccaatattttccccaaaatgatcttctctgatttgactatgcttgttcctccatatctccctgatccctagacttcttctgtcctctatccacattctctcccaaggtgggtcatctagtttcatgactttaaatcctcccttaaactgttggttctcaaatatgcacttgtcacttctctcctaaactccagactcatgtattcagctacctacttgacacttctgtgtggatgtctagtaggtaataatcttagaattattgtgccctgtcaaattcctgctcttccctctaaaatatcttaatactattcagtcttccccatttctgtttatctcagttccttttcaggtcaaaaacctgagttatctttgattcctctctttctctcacattctagtagtccagttcctttcataatcagatcaattagtaagccctatcagctccatttttaaaatgtaactaggatcccaacacttctcaccatttccactactactctgtctcccacctgattctttcaggagccactcgattcgtttcctgcttctaccctcactactctacagtctattgtcagctcagcagccacggtaagcctactttcacttccctgctcaaaactctattggactcttcatctcagagtaaaggtctttccagtggtatacaatatccaatcatatctctccagattgcctaccttcctcccctcactccctccattccggctgcactggctccttgctcttctttgaacgcattaggcacatcctgctccaggacatttgcacttgatgttccctctaactagaatgctctttctctggatattcatatgtttctctcctcatcaccttcaaatcttttccctcatgtcatcttctcagagagacatattctgaccaccctctttaaactgtagtctttaccaatattctgtactacttattcaccatctctgcttttgtattttcttcttagtatttgctactttccagcatgatctgcttttccctaatattttatgatttatcacccattagaatataaggtccatgaaaacacgaaaaatattttctttttttttttttgactgatcccactgcctagaacagtgcttggtgcatagtaattagtcaataaatatttgttggatgaatgagtagatgtcttgaaagtcaaataggaaggaatatggtgatgtcatacaattttattaaaaaatatatgcatccctagtattctaagaattagcacatagtaaagttatagcctaattttataaactctaaaatcacttttatggtttttagctgctgtttttcaagataaaactccaaacaagtacagttttcagtatttcttatgatatattcatcattatttcaaatgcattggctttatggggcctgcacaatcatctttagataaaaatgacctcttatatttctgggtgactagacacaagccttaattaatttttaaaaagggattctatgcagaagggacagtgtttctgcctgtcttctttcacactttgcacacccaggccatctggagtgaaaatgaagtctgcccagagctgctggaagccccagctgccctgctgcccatggagtcctctgaggacgactccagagtccctcaactccttggaggagataagcagccaacacagtgttgttcagcagatgccaccgtctgccatgccctggaatttgaaccaccatcttctggagtgactcaaatgcagaggaagccaggcctgctgctaacgtttctgagaggcggcaagagtataaatggagatccacatatgtataaataaagagtgtgaatcaagctaacaaactgtttaataaaatatgatctaccc

SEQ ID NO: 11508 - DNA, 260 bp, Homo sapiens
  ENST00000513905
taaacgcctacgtcagaatctggagtcagctggagtgtgccagcagcaagatggcccttaccagatgctggcaccttgatatttgacttcccagcctccagaactattcattaatgatgtcagaagtgtaaaactaaaggcagaagactgttgttttcaagattgctccccaactaggcttggcgacccttgaaggcagaggacctttctgagttatctttgtaccctgcatagtcctggcacaaaatagcacctaagtc

SEQ ID NO: 11509 - DNA, 812 bp, Homo sapiens
  ENST00000441345
agaatctggagtcagctggagtgtgccagcagcaagatggcccttaccagatgctggcaccttgatatttgacttcccagcctccagaactgtgagaaacaaatttattttctttataaattactcagattgtggtgttctgttacagcaacacaaaatggactatgtgaagaaaaccatgttggaatcttgtgctgtcattgataagaaaggatctgagcattaggtcaatcaccaaaaaactgaaaaatcagtaacaatgatgacagactcttcaaataggatgatttaaattttaggaaattggaagaagactccaagaaacttaacaaggtcctccaatattttccccaaaatgatcttctctgatttgactatgcttgttcctccatatctccctgatccctagacttcttctgtcctctatccacattctctcccaaggtgggtcatctagtttcatgactttaaatcctcccttaaactgttggttctcaaatatgcacttgtcacttctctcctaaactccagactcatgtattcagctacctacttgacacttctgtgtggatgtctagtaggtaataatcttagaattattgtgccctgtcaaattcctgctcttccctctaaaatatcttaatactattcagtcttccccatttctgtttatctcagttccttttcaggtcaaaaacctgagttatctttgattcctctctttctctcacattctagtagtccagttcctttcataatcagatcaattagtaagccctatcagctccatttttaaaatgtaactaggatcc

SEQ ID NO: 11510 - DNA, 461 bp, Homo sapiens
  ENST00000486145
cagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaagaagaaatgtctggaagtgctacagccattttgcaactgtgaaggcaaaactcacactctaaagatatcaggacaagaacctggaagtgtgggtcctcacttcttccttgagcatctatactcatcctgaactacagtttccagaacacatttcacatgagaagaataagcatcttttgtctacagatcccaaagcatccttggacacaattcagagtttcatgaacttgagcggaaagagattacattttcattttcacaaagc

SEQ ID NO: 11511 - DNA, 424 bp, Homo sapiens
  ENST00000470454
gcccaccaatcgttcctcccagtcaacagccggctgagcagcgtccagattcctgtgaaagtttgagtgttcaaggatgatttaatcccagaaagctggagagcttggagacatccaagatgctgacaaatggaccaccgaagaaaaagcacttagcacatgaagaaatgtctggaagtgctacagccattttgcaactgtgaaggcaaaactcacactctaaagatatcaggacaagaacctggaagtgtgggtcctcacttcttccttgagcatctatactcatcctgaactacagtttccagaacacatttcacatgagaagaataagcatcttttgtctacagatcccaaagcatccttggacacaattcagagtttcatgaacttgagcggaaagagattacattttcattttcacaaa

SEQ ID NO: 11512 - DNA, 2913 bp, Homo sapiens
  ENST00000484535
aataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggatgatttaatcccagaaagctggagagcttggagacatccaagatgctgacaaatggaccaccgaagaaaaagcacttagcacatgcacatgctcaccaaaatgcaataccatgctatggtcgctcattctgtccacaaagattgcagctttctatgcactctaactgcattctgccacctgcaccctgtggcccacttgaaatgaagtttgactacatgacctgcttctttagccaataaaatgtgagcagaagtgatgcacttccaggtgacagatttaagaactggcatactttgccacttgatttttttccactctacatagcaactgtaatgttcaagatgctggcttctccatcagcctgcatcccagaacggggaaaacaaagtggccctgggaaaaagatgaaaacacaacttttctatcaagcccaatagattgaagtcaagagagagcaacgcacgtcttgaaaagaactgagtgggctgggcgcggtggctcacgcttgtaatctcagcactttgggaggccgaggcgggtggatcacctgaggtccggagtttgagaccagcctgaccaacatggtgaaaccccgtctctactgaaaaaatacaaaaattagcttggcatggtggcgtgcgcctgtagtcgcagctactcgggaggctgaggcaggagaatggcgtgaacccaggaggcggagcttccagtgagccgagattgcgccactgcactccagcctgggcaacacagcgaaactccgtctcaaaaaaaaagaaaagaaaagaactgagtgtaactgtgggcacatgaagctgatcagaattaaatagataagaagccaattaagtttttgagagagttgtatagccagagaaatcaggagcctgaactagaaatatttacaactgttcaaaatttaaagctaccctgggccctccccctttccccaggcaggaggcaggctgagaaagctgttctgcccccaaggaggacatattcttcaatgctcactttagatgtgggcaaggaaaggtaaaggaaaatttgcagaagaaagaaccaaatggactgaggagcaacagaatgagaacactgtaggatagcacttcctggccccctatgggaggtggagccaagtcatctcttctaatggtgtgagtggaagtgatgggtccttctcatcttttctgatggtgtgagtggaagtgatgggtcattctcatctgttctgatggtgtgagtggaagggatgggtcgctctcatctcttctgatggcgtgagtggaagggatgggtcgctctcatctcttctgatggcgcgagtggaagtaatgggtcattcttgtctcttctgatggtgtgagtggaagtgatgggtccttctcatctcttctgatggcgtgagtggaagtgatgggtcattcttgtctcttctgatggtgtcagtggaagtattgggttgttctcatctcttctgatggtgtgaagggaagtgatgggtccttctcatctcttctgatggtgtgagtgcaagtgatgggtccttctcatctcttctgatggtgtgagtggaagtaataggtcattctcatctcttctgatggtgtgagtggaagggatgggtcactttcatttattctgatggtgtgagtggaagagatgggtcactttcatctattctgatggtgtgagtggaagggatgggttgctttcctgctgagtgtgtttcttactttccagtgagaggtcctgcagaacactttattccttctggcttaaagactttatcattctgccagactggatccttgagagcctatgataagtagagtgcccctgccagcccatgacagcatgctgtgtggacaagaaacaaactttcattgtattcagcttagatttgagggtcgtatgcttctgcattacctacttatcactgatacaccattggagcaaaaaatcccatctatgaagaaactccaatgatttaccctatatagttctttctctgaatatgtcgtatgccttacctagtgaatcctggggctaaaatggtattgaaatggtcagatccaatcctgagcccctagtcttatgaactaggcctcctctaacaggcagtgctaagcttccatcattcccagacagtggcccaagatgaaagaagacttctctttcccagcttagcttgaatcacaaagcaatccatttgttttggccaaggggatgtgctactcttttaactcagggtcgcaggctttagggtgcacgcgatggaaaagaactcacttgtaactgttgcaccttgagttcttcttgttccaaaaagctccagaaagaagctcagcccc

SEQ ID NO: 11513 - DNA, 419 bp, Homo sapiens
  ENST00000460459
ggactggttaaatatgttgagcccaccaatcgttcctcccagtcaacagccggctgagcagcgtccagattcctgtgaaagtttgagtgttcaagatatttcacacactcctgaccaggctgtaacaagatgattttttagacccacttttcatccaaaacaaggatgatttaatcccagaaagctggagagcttggagacatccaagatgctgacaaatggaccaccgaagaaaaagcacttagcacatgcacatgctcaccaaaatgcaataccatgctatggtcgctcattctgtccacaaagattgcagctttctatgcactctaactgcattctgccacctgcaccctgtggcccacttgaaatgaagtttgactacatgacctgcttctttagccaataaaatgtgagcagaa

SEQ ID NO: 11514 - DNA, 2650 bp, Homo sapiens
  ENST00000295966
gggaaccaatgggcgcggccggaacgcgggtggcgctcggcgctgctctttcgcggtttgattctggggtggggcggcagcgggagcgcgcccgcttttcctaggccagcgggcggttgtctgtggctccgcgactgggcgccccgtcacggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaagaata

SEQ ID NO: 11515 - DNA, 2617 bp, Homo sapiens
  ENST00000482387
aattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatgctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaag

SEQ ID NO: 11516 - DNA, 2761 bp, Homo sapiens
  ENST00000468415
gcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcagctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgaggtaggagcaagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgcagccaatctacatattatgcatccgcatccccctcaagaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagagggtaaccacagtatccagggttctcgaggcccaacaactggtccttcagagttaactcagttaacattagagagcctgctggggaaggctgcaaagcggacaagtaaggaatatctaaggagcgcctacacagaagcaggagcaacagaaagccaggattcctcgatggagcaaatagatagaaataactttgaaatgagtttgttgcctacaacatgcctttctccaactggaagaaggtgtgggtcctgtcagaaaactccagagcccgtaatcaaagcgaaggatctatcagcccagcaagtgccagcttcactaaacaaaacctccctgaaagaaatctcaggggaaaggctgagctcgatccccgaagcatctgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccacccggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatccatca

SEQ ID NO: 11517 - DNA, 428 bp, Homo sapiens
  ENST00000495572
agcataagtaccagcagtgacgacacaaccacctggaactcctgcctgccaccccctgtcaaccagggtcgccactatcagaaagaaatgaacccaccttctccttctaatccccgcctttaggtcctttgccatccattaagacaaatcagatgcaatttggtgctcaggacaagaaaatgctgttggatgtttggtgtaggcatgggaaaaaaaaactatattctgaaacaagactggttagaaggcagcttcccacattttgagggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatcca

SEQ ID NO: 11518 - DNA, 4108 bp, Homo sapiens
  ENST00000472469
ggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaattctgtctatggtgttcccttttcaacagatgagcctacagatattataccacgaagctgtcaactaatgacagatgttccacatgtcacacagctgctaaacatgactaaacttcgccaaactgaaataaaattcggaggccatcctctaagatcagcagaatcagatcagttcattaacagaggaacaagtattacacggaacagtaaaaatcaagatgtttgtcatatcgcatttggatccaaagttcttgggccacctccactctctggcagaaggaataacatgaagatatccagcgagacagtgagatccgttgggtccaaaaataaccgatcatgccagccgtccactgtagagaagtgtgttaatggtacagaaatgtcagccttgctgatacctgagtctgaggaacaaggaaataaagaaaatattcaccaaataaagcagactgtacctattcatgaaccatcagcagataagaataataacagaagaagattacggttaaaaagtaccagcagagaaaggacagagacacccagcggtagctcttcaggaaataataggattgaagataaagcatcaactatcctcaccactgtgtcccaacaaggagcagagctgttgaactccggcactctaggaccccagtctcctgatcaatcagatgagtggatttttcctgaaaatgctgatcacatttcatatctggcatccagcagacagtctctacttctgggtgatgactcctgcaacccatcacacctgtggctggaagccagcaaagagagtgaacacgaccagcaggcagaggaatcccagagtgttccaaaggacattttcactttttcatcaagaccacgatcagcacctcatggaaagactcagactatgtccccagaggagctctcatttattttggatctaaaagaggataacagtgtgacaagcagagacacccaatcagaggatgatttttacggcggcgacagcagtgaagaggtacactgcttgataagtgaagtagtcttgaagcacagttgtttccttagctccaataagcactaaaacaagttgaaatgaaagagggaaaatcaactgctatttataaaaatgcaacagattgccatgtcagtccacagttgcatcaggttgttatggtaactttaaactgtctttttttttttttaattaacagtcagccaatttcacttttacttatagaaaccagttttgggtttctttctgttttttcattttaatctttgaatcacaggatgagaaacgatatgcagtttagtgctatgatagcaagaccagtaaaacactgagaatatactgttctagatctctggagaaattgtgttgcagttgctaagcattctaaattgatggttttctggcttccttactcccctgccatcttttcaccttagacctattaggactcattattttccatatggtcccagaatttgaagagttgtgccaattaaagtttagataatgagtcgtggattagtgctgggacttgccttacaggagattttctgtttgcaattatttagaatatggatatatcctataaattagcaaattcgtaaaaagttttaaaatgtttcaaatcaaactgaatataatttggaaatatttgtttaaaacctaatacattgataactttttccccataggaagtgcatttagtcgtggattttcttcagcattatttttaacgatggtcattcatactttctggaaaaatttattctaaaagcagaatacgaacaactttagggttagtgaaaatgtacaaagcttttctatatagaaattatagaaataactagaaaacctttttatatgtgcccacaaaatatttttataacgtaactgattaagaatcctttttggacagtgaggcacagattaagtccatagcaccaaccttcggaggcagttgagaatatagtgggattgtttaagcagtaattctgggttttttcaacttttaatgagtttcttcagcaaagcgcgtagaggatcgtcttttcacaatattcttgcttctgagtgtcatgaaacaattagtcataccaaacataacctactgcaaatccttttatacataaatagtgcatttgatgctagcattttaagtgttgctgctggacacatttgttcctttcacctttaataacataaagctataaaaacatggacatttgtcttcagcacctaatagtgtcctcatcccagctgataatccttccatggtctaaactggctgattaattcagttcattttatgaatagaatagactcatccccttcccatatgcacagcacaatctctcttactaatgcaaaagcattactctaatagtgggcatttcatggtaggtgggaaatggtagttctctggaaaactatgagagaagtattatggataatctgccctttaaatacaccacatgaagaacttacctcttccatctataggaaggctaagcctttagaagaaacagtagagcttcatgggaaaatgaagaatactagctctgaatattttaatttgatatcacttaatgctttcttttgctgtagctactctgcctctgacatccttcaacgtttattatgcagatgtgtatttgttaccaactacataaaattgaaaacaaatttatcatgcattacccaagctttcactggcagggctatctggtcacccctgtgccatgcccatcaaggtgaccagtagcatacggctagagtctgtggtgagaccatcccattgccaacactggcactcaccaccctttaatcagagcctactaagagtggcagccagagagaggggaaacacctgccacattatcaagctttggggtttgctggtacagagactaacgagatacaagctaagatacaaaaataggaccaacaaaaatgctaggctatatttaaacaagttttagcatgtgtaatgataccttcttaacaaaattggattttttcttttgtacttttggtaatttcttttcctgtaggatagcttcttctatttattaattgtataaatcaatgggaaattaggctacatatttacaatgtttatttacatatagtctttgaagaaaaatcagtttagttaattaaggcatccttactattaattgcattattttagaatgttacatccttatctttgtataattatacttcaggaaaacataatgtcaagttgtaaataatggtggacaagtgaataacaattatattattatgcttgaagtttataaagtgtaattaaaagactttatttgatgtta

SEQ ID NO: 11519 - DNA, 949 bp, Homo sapiens
  ENST00000479931
aagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtaactcagctccctggaattcataaggtagcacaccatactgctcagatggttttaaacaaccaaaagtattgaaagaatactgatgcctccttttgattttcatctgggattattatttgttaaatcaattcttctagaagtccaggaagcagggctgcatataagatgtcaaagggttcagaagacagcattttatttcaggttttcactggcctccagaattctcttcatcttctaatttaaaaaaccttcatttattaatattggc

SEQ ID NO: 11520 - DNA, 832 bp, Homo sapiens
  ENST00000491845
gcttttcctaggccagcgggcggttgtctgtggctccgcgactgggcgccccgtcacggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctgcaaaatgtgatactccagcattcttttcccaagagatatgaagatcttctgacaattcaaatgagattagtgtagactaggacttctcaaaccatttgaagaacgagaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagctacggaagatcttcaccttaaaatcaaagccacaagacactgctgataaggatggtatgttcaggttgctatcaagattttttaattctctgatgtatttttaaaattagccatacctttgggatagtatgagtgtgtggtagcagtttgatgttatgtctgctaaagtaaatttgtcaacagtcatgctga

SEQ ID NO: 11521 - DNA, 917 bp, Homo sapiens
  ENST00000471288
gctcggcgctgctctttcgcggtttgattctggggtggggcggcagcgggagcgcgcccgcttttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtaagcta

SEQ ID NO: 11522 - DNA, 491 bp, Homo sapiens
  ENST00000478363
agaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctgttacaggaggtttttgatggtgaaaatcaagcctgtattacaagtgaagagctgttttacaagcagcctccttgcagcaactaaattgcccccaaaaaagcacataagtgtaatgaagcttttaagtagtcacacatatgcatttatattctctctctcatgaatgactaattttaatttttttaaagtagcaattcagcttgcttttagaaccatttaagctttgcacatgattttgttttccccccaaagccaactattcttgattatgagataggggaaggtttgcatatttatttttgcaaagacagtagcataagccctcatcaccata

SEQ ID NO: 11523 - DNA, 508 bp, Homo sapiens
  ENST00000461011
tggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacagaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 11524 - DNA, 426 bp, Homo sapiens
  ENST00000469903
ttttcccagctacatataaggaatttgaaagtcacataaaatggttaagaaaatgtgccaagattacctcagtaattctggtctgtgttctcaggagaccctggaaataaacaatgaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 11525 - DNA, 711 bp, Homo sapiens
  ENST00000483854
ccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcggtggcctgcagggttatagagtggaaagtcccacaatctttttcttctctattttcagaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 11526 - DNA, 696 bp, Homo sapiens
  ENST00000475317
tgaagacacgttgagacaggtatctcgacctgccaagtataaagctaaagctgagttcataaaaagggatgatttggccgacggtcatctgccagattctgatgatgattcagaagtcagtgtggaagaagatcagagggagaggcaggcgctctttgacttatcaagctgctccctgaggcccaaaagcttcaagtgtcagacttgtaaaaagtcatatatagggaagtggggactggcccagcattttaaacttaatccaggccatggccagctggaccctgagatggtgctatctgagaaagccaatgggagcaccctccgggggtgcacagaggaaaggacgctcagcctgaccttcccggggctgtccgtgccagcggctccgcgtgagggaggggcccgctcctgcttggtgagagagtcagcacgcggtggcctgcaggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 11527 - DNA, 856 bp, Homo sapiens
  ENST00000425492
gcgcagggcccccgcctggctctacaagcccgggccgcggcccccgccttccccgccgcctcccggcgctccgtgcccgccccacgaggccggcggctgctgctacctggggccgttgctgcttgtgccgtgagcgacggccagccattgtccccgccgctccgtcagccgcgcccggccgcgcgcgcaccggaaggcgcattggcgtcttgcgggctccgggccgggtgggcaggatggcctccacaagccgcatggcgcgcatggggagcctccgttgatgccgccgcgccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaagaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaattatttataa

SEQ ID NO: 11528 - DNA, 922 bp, Homo sapiens
  ENST00000471090
caaggcaggtggatcacaaggtcaggagatcaagaccatcctcctggctaacaaggtgaaaccctgtctctactaaaaaaaatacaaaaaattagccgggcgtggtggcatgtacctgtagtcccagctactcaggaggctgaggcaggaaaatcgcttgaacccaggaagtggaggttgcagtgagccaagatcataccactgcactccagcctgggcgacagagggagactccgtctcaaaaagaaaaaaagcaataaatgctcttccagaaaactcaaaaatgaagataagctaaaagaaaatggaaagcaccagaataccagaatctttccactcactgatgatcagagttaatacctcagtgtcttctgtggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacagggttatagagtggaaagtcccacaatctttttcttctctattttcagaaaaacgttgacctcttggcgagaatgcaaagaagggaacgcttgcttatacgctgttggtgaactgtcacccctacaactcagcttgcaaccagccctggccaccagtttccccacactgagctgaatatcggacatgcccatctcagacattccagcccattctgaaattccacatcgattcacctgacaaagtctgaagttccagggcaatttatctggaaaagcttacctggaatcacgtgtcatttcaaccaacaactgttgaagaggacgtggcattaaaaccaagggtatcaatta

SEQ ID NO: 11529 - DNA, 904 bp, Homo sapiens
  ENST00000486571
tgaccttcccggggctgtccgtgccagcggctccgcgtgagggaggggcccgctcctgcttggtgagagagtcagcacgcggtggcctgcagtgtcttctgtggcttcagcgtcacctagtgcaggctgccattcaacaaacgcattgtcaacagtcaaccaaaagaaacccattggccaccataccctgaggactaaccctgacacagatgcccttccagatgccctcaatagtctaactgattccatcgccccagccttgggggagaagcactgctgcctatgcactccatttacaggctaaaatcacactcgatgtttttatgggatcatttgatctggacattgtcaaagaaaaaattgcaccagacaagttaaaccttcaaggaaggactcagtcaggactactgcaatacggaagagaggagcttaacttcattgaaacaaaaggctggggagtttttaagtgccggggtgagatgctgagaaggaactggagacatcaggaagaggttaggaaatgccgtaaagctatctgcgttggctcattggaatttttcaaaactgggaatctgcccttctacaaaaactgagacacagatgtatcatctccttcaataattgcattttaaagggatggctctgaagtcttgagaaaggcattcctgggttgcaaaactaggaggaggctagaagaaaatttgggagaagatttgcctctcaaagaggtagagaaagaactcacaattgcaagtttcctaaaataaatcctccgtgaaaaaaggaggcctgatggatggaactggaggtcattatgttaagtgaaataagccaggcacagaagaaaaatactgcatgttctcactcacatgtgggagcttaaaacctggatctcatgaagata

SEQ ID NO: 11530 - DNA, 726 bp, Homo sapiens
  ENST00000490920
ccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaaggtaacgtctggagaaacaaaaggtcaggaatggccaacgtccctactggccacagtccagccccaatctgcaagacagagccagccgccccgggggaattcccgcctggtgggactccacgtcaccagcccccagctgctcagggtacagcccctcgtgagaaccgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagtttgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttc

SEQ ID NO: 11531 - DNA, 1440 bp, Homo sapiens
  ENST00000586625
gagtagggctgattggagccattgtacagtgtcgggaacataccaggacactgagaatagtgtcatgtcataaggacccagagcagatggaccctgctgtgatgcacaaagggatgaaatgggattttgttggcaccaagacctgattgctttgccagttaccctcacccctggctcacaaggaaagtgtatggaggagattctcgaggaaccacatgagttttaatatcataagcttctgccctgaattgaaaggagctgggctgcttggatcagaggttccatggtctgaactactccactctggtgaaggtttcttccccaaagccactcctcaagctgacttatattgtacctgagttgcatgcctgtgctccaagagcagacgtccttccgcaggagcaggtcattaagagtcactgcgttgatcatgtagaagagctgtttgaatacctgcaggatgatctcagggtccaagccctggtcacacatgactgtatgaaaggcattcatctggcggatgatagcttccaggcggtatgagttatccccatctgccatgctggaggagtgcttctgggagccagtgggcttcacaccagatagaccctgaatgctgtcattttccaacatggcagaaactatcatcggctgtaacacaccctcggcaattttaaagagctgctggtagatctgaatggaaaggtcgctcagtacctgacggtattcggtgaggtcaaagttcttaaggcagtgttcgttgtgctttgctgtattctgagtcatgaagccctcatccccgctgtaccgcttcagacagtgaagaaggtggcaggtgttggataacaggaatgacgtcatctcaaagtcatcactgtgcttcttcaggactttcttaatgccgttggtggtggaggtcatcagggagtgcaccttgagatcatcgttggtttggtccgcgagccgaatgcacatgtagaggatgtaggcggagagacagggcactgtgtccaacagcatctggggcttcaagtctgtcaccaggttgaggatgaggagggcctcgccctctttgcggcactccaacatgccctggaaatccttttctttccactgaactgggacctgcctgttgaactcatggcgcttcctctcactctgggccaacgcctgggcagcttcttcatgtaaatcttcagttgcttttagagcttcctctcattcttttcctcttactttatttttcaccacagagcttcctatcaactagtatgttgaatattttgcttattaactttgtttattgtcttctccctcgattagaatattagctacttgagtacaaggatttgagcctgttacattcactgctgaattttaggctcctggaagatacccagcattcaatagagaccacacaataaatatatgtcaaataaa

SEQ ID NO: 11532 - DNA, 1091 bp, Homo sapiens
  ENST00000591993
gcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggcaggagtagggctgattggagccattgtacagtgtcgggaacataccaggacactgagaatagtgtcatgtcataaggacccagagcagatggaccctgctgtgatgcacaaagaaatcaatggagcctattcttccaaataatccttaaatattacttatctcaactgagattttggtgaaaatttagctttagagcttttattgacctgccaatgacctgaagttaagattattcttttctactgaatgaagacaaactaccttataaaaattaacccagaaggctgtagagggatgaaatgggattttgttggcaccaagacctgattgctttgccagttaccctcacccctggctcacaaggaaagtgtatggaggagattctcgaggaaccacatgagttttaatatcataagcttctgccctgaattgaaagatagcagcattttaatcatctcttccattaaaccaagattacacaaaagcgtttgaggacactgaggactgggacttctaattttgcttcagaaaccagtactcaaaatgtctggtttggaggagctgggctgcttggatcagaggttccatggtctgaactactccactctggtgaaggtttcttccccaaagccactcctcaagctgacttatattgtacctgagttgcatgcctgtgctccaagagcagacgtccttccgcaggagcaggtcattaagagtcactgcgttgatcatgtagaagagctgtttgaatacctgcaggatgatctcagggtccaagccctggtcacacatgactgtatgaaaggcattcatctggcggatgatagcttccaggcggtatgagttatccccatctgccatgctggaggagtgcttctgggagccagtgggcttcacaccagatag

SEQ ID NO: 11533 - DNA, 1602 bp, Homo sapiens
  ENST00000445604
agtgaggtcggcgcccgccagtaacaaacatggctccctgaagccgctcaggctcaagagcaacatggaggtctgcacttaatcgctcctctccgggggcggccataccgaggaggcgtctcttccgtgcaggcaggctctcctggggacctcagagattctctccagcggcagcggaaaacggacaatgggtggattcgggtccagattctggtaggagggagtttgggatcgagatctggaaaaaagcactagactggaagaggacgcgatggagtcggagccgctggcggggacaaaaaccagaggccggggaaggcgccggtgggaggcaaggcacggatggactttacctgcgcacgcgtcgcagccatctccgcgcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggtacctatcttgtgcagggccctgagatggggtctgactcagttcctgcggggaacttcaccagtgacccagtcagtgcccttcagttaaagaccaccaggagcacacttgcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactgaattttggttccatttttgtatctcagcttccaggaaataaaaaagaattctaacattcatactttcagtattttatgtgagaggttttgttgtcaaaatcaagtctgagagcaatgtttgttggggcctttaattggagtcaccaagcgataaaggggacattgtcctcaacaataaccctataataaacacgttttggacaataaatatatgacaatttcttaaaagcaatttcttgggcaatcaagacagtatggcttgagtatggagttatacgatggtttggattaatccagtattaaatctttggttattacagaaatcaatggagcctattcttccaaataatccttaaatattacttatctcaactgagattttggtgaaaatttagctttagagcttttattgacctgccaatgacctgaagttaagattattcttttctactgaatgaagacaaactaccttataaaaattaacccagaaggctgtagagggatgaaatgggattttgttggcaccaagacctgattgctttgccagttaccctcacccctggctcacaaggaaagtgtatggaggagattctcgaggaaccacatgagttttaatatcataagcttctgccctgaattgaaagcctacatcatcctgtgcatttcacaaaatcctaatgaaaactacacgaagctcaaagtatagataaacatatcagtgttgacaaccgtgaaaccacgctatccaaaggctacgagctctgaggaattcctgttagct

SEQ ID NO: 11534 - DNA, 1031 bp, Homo sapiens
  ENST00000438699
aaaaaaaaaaccttaaatgcccatcgctaagtgaaagaagccgatctgaaaagactacatactgttatcagccttttgccaagctgaacacaaggggatgaaaagaaaatctgggctcgaatgtgcaatttcatattttctgttaaggcaatttacaacatatcataaagctgcattaataaacagatgttccacagtctgcagaatataaaataaatgtcttgaataagctacgaagaccaaggcacttttcggagcagatttttttgtcttaaagttttatctcatgcaaacactgcgtataacacaaacttatataatcaatgcttttagcaaaatgtcatagtagaaccaaggcccagttgttagctgaaatctatataaatataggcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactgaattttggttccatttttgtatctcagcttccaggaaataaaaaagaattctaacattcatactttcagtattttatgtgagaggttttgttgtcaaaatcaagtctgagagcaatgtttgttggggcctttaattggagtcaccaagcgataaaggggacattgtcctcaacaataaccctataataaacacgttttggacaataaatatatgacaatttcttaaaagcaatttcttgggcaatcaagacagtatggcttgagtatggagttatacgatggtttggattaatccagtattaaatctttggttattacagaaatcaatggagcctattcttccaaataatccttaaatattacttatctcaactgagattttggtgaaaatttagctttagagcttttattgacctgccaatgacctgaagttaagattattcttttctactgaatgaagacaaactaccttataaaaattaacccaga

SEQ ID NO: 11535 - DNA, 459 bp, Homo sapiens
  ENST00000585533
cggggaaggcgccggtgggaggcaaggcacggatggactttacctgcgcacgcgtcgcagccatctccgcgcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactgaattttggttccatttttgtatctcagcttccaggaaataaaaaagaattctaacatt

SEQ ID NO: 11536 - DNA, 716 bp, Homo sapiens
  ENST00000612590
ctaagttcaattaccagctgccctttatcattgaacttaatgctttcttctcatagtagaattaagaggaaagtaaaatattttttgtacctatatctttattatatttagacaaatcacagagtgagagagtaggggtttcaagaacaataggagagagacagggaagagagaaagaactgcttgtggaaatacagaatatcccacattttcaatgtggaaagtgtatgagggtctgaaagaaaatactcagttttttttgtcctgtaagaggcagcattgacaaatgtgtaccagagtttgggtacatttgagccagttcttcagaatcgtggggtgggaaatagaacaaaattatttacacctaattctaggcagataagtgtgcttcaaggaaaggcaagggcctggctagattctagatgtttttaaactggaggccagagacagctttagggagtctatatacaggcacaaatttatttcttttatattcttcttgctctttgaaaacggtctttatgcaaatacacactatataaccaaagtttctctttgttccaggcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactg

SEQ ID NO: 11537 - DNA, 477 bp, Homo sapiens
  ENST00000609749
ggaaatacaacaaaacgcctctcccgctcctttagcaaaacatgtgtcagagcaacgcaagatttgattgggactgctttacttcgttaacaattacatctgttcgtgacatttggtattcctaatatgcccacttggaggaaattgccagcttaggccaaccagggtgaaatgcatgcgcttataaactcataagcccaataataattttcagaaggaggcactcattcacttcggcttataaacttgcaaatctgtagattcattagtctatcacttacatggaaagacaaaatttatatttaattgttgagacttgacttcaaaattttcaagaatatcaacatttgtttttgttgtgcacctctctgtcaaaagtatcagccttttgccaagctgaacacaaggggatgaaaagaaaatctgggctcgaatgtgcaatttcatattttctgttaaggcaatttacaacatatc

SEQ ID NO: 11538 - DNA, 1215 bp, Homo sapiens
  ENST00000400375
tcactcactcacacctcccgcagctcacctcctccccaccccagcatggccgcgtccaccatgtccgtctgctccagcgcttgctccgactcctggcaggtggatgcctgcccagagagctgctgtgagccccactgctgcgccctcagctgctgcgccccggccccctgcctgaccctggtctgcaccccagtgagccgtgtgtccagcccctgctgccaggcagcctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctccagccagcagtcctgctgtgtgcctgtttgctgcaagcctgtgtgctatgtgcccacctgctctgaggattcctcttcatgctgccagcagtctagctgccatccagcttgctgcacctcctccccctgccagcaggcctgctgcgtgcccgtccgttgcaagcctgtctgctgcaagcccatctgctgtgtgcccgtctgctctggggcttccacttcatgctgccagcagtctagctgccagccggcttgctgcaccacctcctgctgcagaccctcctcctccgtgtccctcctctgccgccctgtatgccggcccgcctgctgtatgcctgtctcctcctgctgtgcccctgcctcctcctgccaggccagctgctgccgcccggcctcctgcgtgtccctcctctgccgccccgcgtgctcccgcccggcctgctgaggcctctgctcaggccaggagtccagctgctgatgggcacccgccctgggccagctgggctcagttcctgacctgggttaggtggcttcccccacctaggacgggtccccgtgtctcccctgtgctgaggtgaccccccctccttgctcccaggagcctccatccttgcagctccccagctcttgccttccagcaggtgcccacctgcctgctaggtcccctgtcctccctcccagcttctctgctctgggtcacttggcctcgacttgaacctctcagcacctcctcctgctccccaataaactctccttggtcacctga

SEQ ID NO: 11539 - DNA, 1100 bp, Homo sapiens
  ENST00000380095
cactcactcacacactcactcactcacacacctcccccagctcaccgcctccccactccagcatggccgcctccaccatgtccatctgctccagcgcctgcactgactcttggcgggtagtcgactgcccagagagctgctgcgagccctgctgctgtgccccagcccccagcttgaccctggtctgcaccccagtgagctgtgtgtccagcccctgctgccagacggcctgtgagcccagcgcctgccaatcaggctacaccagctcctgcacaaccccatgctaccagcagtctagctgccagccggattgctgcacctcctccccctgccagcaggcctgctgtgtgcctgtctgctgtgtgcccgtctgctgcgtgcccgtctgtaacaagcctgtgtgcttcgtgcctacctgctccgagtcttccccttcatgctgccagcagtctagctgccagccaacttgctgcacctcctccccatgccagcaggcctgctgtgtgcctgtctgctctaagtccgtctgctatgtgcctgtgtgctctggggcttccacttcatgctgccagcagtctagctgccagcctgcttgctgcaccgcctcctgctgcagaccctcctcctccgtgtccctcctctgccaccctgtgtgcaagtccacctgctgcgtgcccgtcccctcctgcggtgcctctgcctcctcctgccagcccagctgctgccgcacggcctcctgtgtttccctcctctgccgccccgtgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaaggtggggcaggctctttgtcttggggaccaggatgctcccccagtccttcccagatgatggctgcctgtgggaccccagctactcccccagacccaagttctgcagaactaacccccagcaggcctggttccaccctgggcagcaccccctctagttctaataaagccgcctctgtctcacaccaa

SEQ ID NO: 11540 - DNA, 1237 bp, Homo sapiens
  ENST00000334670
acactcacttacacctcccccagctcacctcctccccaccccagcatggccgcgtccaccatgtctgtctgctccagcgcttactccgactcctggcaggtggacgactgcccagagagctgctgtgagcccccctgcagcgcccccagctgctgcgccccggccccctccctgagcctggtctgcaccccagtgagctgtgtgtccagcccctgctgccaggcggcctgtgagcccagcgcctgccaatcaggctgcaccagctcctgcacgccgtcatgctgccagcagtctagctgccagccggcttgctgcacctcctccccctgccagcaggcctgctgtgtgcctgtctgctgcaagactgtctgctgcaagcctgtgtgctgtgtgcctgtctgctgtggggctgcttcttcgtgctgccggcagtctagctgccagccagcttgctgtgcctcttcctcctgccagccggcctgctgtgtgcccgtctgctgcaagcctgtgtgctgtgtgtccacctgctctgaggattcctcttcatgctgccagcagtctagctgccagccagcttgctgcacctcctcctcctaccagcaggcctgctgcgtgcctgtctgctgcaagactgtctactgcaagcccatctgctgtgtgcctgtctgctctagggcttcctcttcacgctgccagcagcctagctgccagccagcttgctgcaccacctcctgctgcagaccctcctcctctgtgtccctcctctgccaccccgtgtgcaggtccacctgctgtgtgcccgtctcctcctgctgtgcccccacctcctcctgccagtccagctgctgccgcccggcctcctgcgtgtccctcctctgccgccccgcaagctcccgcctggcctgctacagcctctgctcaggcaagaagtccagctgctgagtgctcaatccttgtctcctgctgactgtgtctttgctgccaagcaggattctccagtctcaggagcccctggagtcctcagaatccaccagctccatcagtagccacagagctgctgcctgaaggggattttgagcgcgtcacactttcctccccactgtctgggaagagacaacccacaaatccctcagcaggtggactgtggctttctggagcccccttctccaaatgtgttgcttatacccaatgtgacaaagaagaactgctctaatcaataaattcttgagtcaggaaa

SEQ ID NO: 11541 - DNA, 873 bp, Homo sapiens
  ENST00000400365
agctcaacccccagcacggctgcatccaccatgtccgtctgctccagcgacctgagctatggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtatccagcccctgctgccgagtgacctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagactgtctgctgcaagcctgtgtgctgtatgcccgtctgctgtgggccttcttcttcatgctgccagcagtctagctgccagccagcttgctgcatctcctccccgtgtcaacagtcctgctgtgtgcccgtctgctgcaagcccatctgctgtgtgcctgtctgctctggggcctcctctctgtgctgccagcagtctagctgccagccagcttgctgcaccacctcctgctgcagaccctcctcctccgtgtccctcctctgccgccctgtgtgcagacccgcccgccgcgtgcccgtcccctcctgctgtgtccccacctcctcctgccagccaagctgcggccgcctggcctcctgcgggtccctcctctgccgccccacatgttcccgcctggcctgctgaggcctctgctcaggccagaagtccagctgctgccaggcatgtcccccagggccactgggcactatgagtcccccacctctcccactactggcccctcggctgctc

SEQ ID NO: 11542 - DNA, 282 bp, Homo sapiens
  ENST00000618832
tgcaccagctcctgcacgccctcgtgctgccagcagtctagctgccagccggcttgctgcacctcctccccctgccagcaggcctgctgcgtgcccgtctgctgcaagactgtctgctgcaagccttctagctgccagccagcttgctgcatctcctccccgtgtcaacagtcctgctgtgtgcccgtctgctgcaagcccatctgctgtgtgcctccagcttgctgcaccacctcctgctgcagaccctcctcctccgtgtccctcctctgccgccctgtg

SEQ ID NO: 11543 - DNA, 1149 bp, Homo sapiens
  ENST00000391621
tcactcactcacacacctcccccagctcacctcctccccactccagcatggccgcctccaccatgtccatctgctccagcgcctgcaccaactcctggcaggtggacgactgcccagagagctgctgtgagctcccctgcggcacccccagctgctgtgccccagccccctgcctgaccctggtctgcaccccagtgagctgtgtgtccagcccctgctgccaggcggcctgtgagcccagcgcctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgtgtgcccgtctgctgtggggcttcttcatgctgccagcagtctagctgccagccagcttgctgtgcctcttcctcctgccagcagtcctgccgtgtgcctgtctgctgcaaagctgtgtgctgcgtgcccacctgctctgagtcatcctcttcatgctgccagcagtctagctgccagccggcttgctgcacctcctccccgtgtcagcagtcctgctgtgtgtccgtctgctgcaagcctgtctgctgcaagtccatctgctgtgtacctgtttgctctggggcttcctctccgtgctgccagcagtctagctgccagccagcttgctgcacctcctcctgctgcagaccctcctcctctgtgtccctcctctgccgccccgtgtgctcccgcccagcctcctgcagcttttcctcaggccaaaagtctagctgctgatggccatgtcccccagggccagccgggctcaggccccacctccctgccagtccttggacctcccagcccacccagcctcagcacagctcagcacagaaggagcagccccagccacagccgcccagccccggggtctcagatgctcactggctcctctctgacctcccgccgggcgggcgagccctggcttctcctcacggtgcttcctggctgcagaccacaaccctccgctggtcgctggtcgctggttggggatgggccctcctgacctgggtctcacccccaggagcgtcaccctctgcctctgagcaccaataaagcgtctgcggcccca

SEQ ID NO: 11544 - DNA, 366 bp, Homo sapiens
  ENST00000498210
tcactcactcacacacctcccccagctcacctcctccccactccagcatggccgcctccaccatgtccatctgctccagcgcctgcaccaactcctggcaggtggacgactgcccagagagctgctggccagccgggctcaggccccacctccctgccagtccttggacctcccagcccacccagcctcagcacagctcagcacagaaggagcagccccagccacagccgcccagccccggggtctcagatgctcactggctcctctctgacctcccgccgggcgggcgagccctggcttctcctcacggtgcttcctggctgcagaccacaaccctccgctggtcgctggtcgctggttggggat

SEQ ID NO: 11545 - DNA, 971 bp, Homo sapiens
  ENST00000391620
tcactcactcacgtctcccccagctcacctcctccccaccccagcatggccacgtctaccatgtccgtctgctccagcgcttactctgactcctggcaggtggacgcctgcccagagagctgctgtgagcccccctgctgcgccaccagctgctgcgccccggccccctgcctgaccctggtctgcaccccagtgagctgtgtgtccagcccctgctgccaggcggcctgtgagcccagcccctgccagtcaggctgcaccagctcctgcacgccctcgtgctgccagcagtctagctgccagccagcttgctgcacatcctccccctgccagcaggcctgctgcgtgcctgtctgctgcaagccagtctgctgtgtgcccgtctgctgcaagcctgtctgctgcaagcccatctgctgtgtgcccgtctgctctggggcttcctcttcatgctgccagcagtctagccgccagccggcttgctgcaccacctcctgctgcagaccctcctcctccgtgtccctcctctgccgccccgtgtgcaggtccacctgctgtgtgcccatcccctcctgctgtgcccctgcctccacctgccagcccagctgctgccgcccggcctcctgcgtgtccctcctctgccgccccacgtgctcccgcctctcttccgcgtgctgcggcctctcctcaggccagaagtccagctgctgacgggcaggtcccgtttctccagagttgttccagggccatctctgacttccgaaaatccttgcagccctgagccctgtctgagtctcctctgcccatagccactgcacctccagccagcaatgctgagctttcatgccgattccctccaggcatgcatctctcccacaccctcatctccatgctggccagccggtggtcactgtgtcctgccccatgtgagtgatcagtctgtcaacaaataaagtcaccaatgtgccctc

SEQ ID NO: 11546 - DNA, 1643 bp, Homo sapiens
  ENST00000400374
agctcaacccccagcacagcagcatccaccatgtccgtctgctccagcgacctgagctacagcagccgcgtctgccttcctggttcctgtgactcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgcccgtctgctgtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagcccctgctgccaggcggtctgtgagcccagcccctgccaatcaggctgcatcagctcctgcacgccctcgtgctgccagcagtctagctgccagccggcttgctgcacctcctcctcctgccagcaggcctgctgcgtgcccgtctgctgcaagactgtctgctgcaagcctgtgtgctctgaggattcctcttcatgctgccagcagtctagctgccagccggcttgctgcacctcctctccctgccagcaggcttgctgtgtgcctgtctgctgcaagcctgtgtgctgcaagcctgtctgctctgtgcccatctgctctggggcttcctctctgtgctgccagcagtctagctgccagccagcttgctgcacctcctcccaaagccagcagggctgctgcgtgcccgtctgctgcaagcctgtgagctgtgtgcctgtttgctctggggcttcctcttcatgctgccagcaatctagctgccagccagcttgctgcaccacctcctgctgcagaccctcctcctccgtgtccctcctctgccgccccgtgtgcaggcccgcctgctgcgtgcccgtcccttcctgctgtgctcccacctcctcctgccaacccagctgctgccgcccagcctcctgcgtgtccctcctctgacgccccgtgtgctcccgcccagcctgctgaggcctccgctcaggtcagaagcccagctgctgatggacacgccccccagtgccagccaggctcaggtcccacctgaaagctgatagtcgcgtcctgaattgctcctgcactttgaccatttcctggtgtctgctgttgagctggacaatggaagaactgaaagtctatactcaatgctgcagccctcttgcggggggaggggggcgcttctagaaagttcccatggcagtggcctcccctccatatctcccacctctcatgagggtcagttcagccttgacccgtgaggtctctgtcctcctggctcagagccgcagagccttctttggacgccctcaagctgaccaataaaggccctgagactgcaatggcgctga

SEQ ID NO: 11547 - DNA, 1244 bp, Homo sapiens
  ENST00000622352
cccccagctcaacccccagcacagcagcatccaccatgtccgtctgctccagcgacctgagctacagcagccgcgtctgccttcctggttcctgtgactcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgcccgtctgctgtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagcccctgctgccaggcggtctgtgagcccagcccctgccaatcaggctgcatcagctcctgcacgccctcgtgctgccagcagtctagctgccagccggcttgctgcacctcctcctcctgccagcaggcctgctgcgtgcccgtctgctgcctgcctgtgtgctgtgcgcccacctgctctgaggattcctattcatgctgccaacagtctagctgccagccagcttgctgcacctcctccccctgccagcaggcctgctgtgtgcctgtctgctctggggcttccacttcatgctgccagcagtctagctgccagcctgcttgctgcaccgcctcctgctgcagaccctcctcctccgtgtccctcctctgccaccctgtgtgcaagtccacctgctgcgtgcccgtcccctcctgcggtgcctctgcctcctcctgccagcccagctgctgccgcacggcctcctgtgtttccctcctctgccgccccgtgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaaggtggggcaggctct

SEQ ID NO: 11548 - DNA, 597 bp, Homo sapiens
  ENST00000616689
gcagcatccaccatgtccgtctgctccagctcttgctccgactcctggcaggtggacgactgcccagagagctgctgcgagcccccctgctgcgcccccagctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagccggcttgctgcacctcctctccctgccagcaggcttgctgtgtgcctgtctgctgcaagcctgtgtgctgcaagcctgtctgctgctgcgtgcccgtctgctgcaagcctgtgagctgtgtgcctgtttgctctggggcttcctcttcatgctgccagcaatctagctgccagccagcttgctgcaccacctcctgctgcagaccctcctcctccgtgtccctcctctgccgccccgtgtgcaggcccgcctgctgcgtgcccgtcccttcctgctgtgctcccacctcctcctgccaacccagctgctgccgcccagcctcctgcgtgtccctcctctga

SEQ ID NO: 11549 - DNA, 1150 bp, Homo sapiens
  ENST00000400372
ccagctcacgtcttccccaccccagcatggccgcgtgcaccatgtccgtctgctccagcgcttgctctgactcctggcgagtggacgactgcccagagagctgctgtgagcccccctgcggcaccgccccctgcctgaccctggtctgcaccccagtgagctgtgtgtccagcccctgctgccaggcggcctgtgagcccagcccctgccaatcaggctgcaccagctcctgcacgccctcgtgctgccagccggcttgctgcgcctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctcctgccagcagtcctgctgtgtgcctgtctgctgcaagcccgtgtgctgtgtgcccacctgttctgaggattcctcttcatgctgccagcattctagctgccagccgacttgctgcacctcctccccctgccagcagtcctgctacgtgcctgtctgttgcaagcctgtctgctgcaaacccatctgctgtgtgcccgtctgctctggggcttccacttcatgctgccagcagtctagctgtcagccggcttgctgcaccacctcctgctgcagaccctcctcctccgtgtccctcctctgccgccccatatgcaggcccgcctgctgcctgcccatctcctcctgctgtgcccctgcctcctcctaccaggccagctgctgccgcccggcctcctgcgtgtccctcctctgccgccccgcgtgctcccccctggcctgctgaggcctctgctcaggccaggagtccagttgctgatgtgcacatcccccagggccaactggtcctgactcgggttaggaggttgcccccgcttgggacggggcccccatgtgctgaggtgacccccccctccatactcccaggaatctccatcctcgaagctccccagctcctgcctcccagcaggggcccacctgcctgttgggtcccctgtcctccctcccagcttctctgccccatgtcacttggcctcgacttgaacctgtcagcacctcctcctgctccccaataaactccccttggtcgcctga

SEQ ID NO: 11550 - DNA, 1238 bp, Homo sapiens
  ENST00000400368
ctccaccagttcaaccccagcatggccgcgtccaccatgtccgtctgctccagcgacctgagctacggcagccgcgtctgccttcctggttcctgtgactcttgctccgactcctggcaggtggacgactgcccagagagctgctgtgagcccccctgctgcgccccggccccctgcctgagcctggtctgcaccccagtgagccgtgtgtccagcccctgctgcccagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtgctgtgtgtccgtctgctgtggggattcttcatgctgccagcagtctagctgccagtcagcttgctgcacctcctccccctgccagcaggcctgctgtgtgcccgtctgctgcaagcctgtctgctctgggatttcctcttcgtgctgccagcagtctagctgtgtgagctgtgtgtccagcccctgctgccaggcggtctgtgagcccagcccctgccaatcaggctgcaccagctcctgcacaccctcatgctgccagcagtctagctgccagccaacttgctgcacctcctccccctgccagcaggcctgctgcgtgcccgtctgctgcgtgcctgtgtgctgtgtgcccacctgctctgaggattcctcttcatgctgccagcagtctagctgccagccagcttgctgcacctcctccccctgccagcacgcctgctgtgtgcccgtctgctctggggcttccacatcatgctgccagcagtctagctgccagccggcttgctgcaccgcctcctgctgcagatcctcctcctccgtgtccctcctctgccaccctgtgtgcaagtccacctgctgcgtgcccgtcccctcctgtggtgcctctgcctcctcctgccagcccagctgctgccgcacggcctcctgtgtttccctcctctgccgccccatgtgctcccgccctgcctgctacagcctctgctctggccagaagtccagctgctgacagccctggatgtgatccggagtcccttcccaccaggggctgacctcccagctgccccagcaagctctgccctctctggctttgacaccctcagaagatggggcaggctctttgtctta

SEQ ID NO: 11551 - DNA, 1578 bp, Homo sapiens
  ENST00000609664
catctcctccagttcaatccccagcatggctgcgtccactatgtctgtctgctccagcgacctgagctacggcagccgcgtctgccttcctggttcctgtgactcttgctccgactcctggcaggtggacgactgcccagagagctgctgcgagcccccctgctgcgccccggccccctgcctgagcctggtctgcaccccagtgagctatgtgtccagcccctgctgccgagtgacctgtgagcccagcccctgccaatcaggctgcaccagctcctgcacgccctcgtgctgccagcagtctagctgccagctggcttgctgtgcctcctccccctgccagcaggcctgctgcgtgcccgtctgctgcaagactgtctgctgcaagcctgtgtactgtgtgcctgtctgcagtggggattcttcatgctgccagcagtctagctgccagtcagcttgctgcacctcctccccctgccagcaggcctgctgtgtgcccatctgctgcaagcctgtctgctctgggatttcctcttcgtgctgccagcagtctagctgtgtgagctgtgtgtccagtccctgctgccaggcggtctgtgagcccagcccctgccaatcaggctgcatcagctcctgcacgccctcgtgctgccagcagtctagctgcaagccggcttgctgcacctcctccccttgccagcaggcctgctgtgtgcctgtctgctgcaagcccgtctgctgtgtgcccacctgctctgatgattccggttcatgctgccagccagcttgctgcacctcctcccaaagccagcagggctgctgcgtgcccgtctgctgtaagcctgtgtgctgtgtgcccgtctgctctggggcttccacttcatgctgccagcagtctagctgccagccggcttgctgcaccacctcctgctgcagaccctcctcctccgtgtccctcctctgccgccccgtgtgcaggcccgcctgctgcgtgcccgtcccctcctgctgcgcccccacctcctcctgccaggccagctgctgccgcccagcctcctgtgtgtctctcctttgccgccccgcatgctcccgcccggcctgctgtggccccacctcaacccagaagtccagctgctgagtgatctccttaagatcatccaaagcctgagtgctcactgccacctgcacccctggattctttacccttgacggctctccacatcccgctcctaagccctgcagtggacgtcagtggtcagctggccatccagtgtgcgcttctcctcctagaagcagctcagctgtttctccaagtcttgactttcccccaattacccagccctgcttccccagcaacaggtgggcagtgaccccagcaaggccagcgggtgctcccaggccatagcccggtgtggggagaaatgagggtagacaggtaccaactgggtttctcgtcactgtcccagctcagtggcgagccctgctcctcccctgctgtgggcctgggcctctttctctgtcttccctgaccacgggagcaggtcagacccttctaataaactcctttcctaaaaagta

SEQ ID NO: 11552 - DNA, 876 bp, Homo sapiens
  ENST00000334662
accacccagtccagcacccaccatggctgacgcctgctgcaccaggacgtatgtgattgctgcatccaccatgtctgtctgctccagtgacgtgggccatgtcagccgagtctcctcccccagcacctgcactggctcctcctggcaggtggacaattgccaggaaagctgctgcgagccccgctcctgtgcctccagctgctgtacccctagctgctgtgccccagccccctgcctggccctggtctgtgccccagtgagctgtgagcccagcccctgccaatcaggctgcaccgactcctgcacaccttcatgctgccagcagtctagctgccagccggcttgctgcacctcctccccctgccaacaggcctgctgtgtgcctgtgtgctgcaagtccaactgctgcaagcccgtgtgctgcgtgtccatctgctctggagcttcctccccatgctgccagcagtctagctgccagtcagcttgctgcaccttctccccatgccaacaggcctgctgtgtgcccatctgctgcaagcccatctgctgtgtgcctgtctgctctggggcttcctctctgtgctgccagaagtctagctgccagccggcttgctgcaccacctcctgctgcagaccctcctcctccgtgtccctcctctgccgccctgtgtgccggcctgcctgctgtgtgcctgtcccctcctgttgtgtccctgcctcctcctgccagcccagctgctgccacccggcctcctgcctgtccttcctctgccgccccgcgtgctcccgcctggcctgctgaggcctctgctcaggccaggagtccagctgctgatgggcacgtcccccagggccagccggctccggtcctgtcct

SEQ ID NO: 11553 - DNA, 1171 bp, Homo sapiens
  ENST00000397911
tcacacactcacttacacctcccccagctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtggggcttcttcgtgctgccaacagtctagctaccagccagcttgctgtgcctcttcctcctgccagccggcctgctgtgtgcccgtctgctgcaaacctgtgtgctgtgcgcccacctgctctgaggattcctattcatgctgccaacagtctagctgccagccagcttgctgcacttcctccccctgccagcagtcctactgtgtgcctgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgtgtgcaggcccgcctgctgcgtgcccgtctcctcctgctgtgcccccacctcctcccgccagcccagctattgccgccaggcctcctgtgtgtcccttctctgccgccctgtgtgctcccgcccggcctgctacagcttctcctcaggccagaagtccagctgctgacggtcatgtcccccagggccagccgggctcaggccccacctccctgccagtccttggacctcccagcccacccagcctcagcacagctcaacacagaaggagcagccccagccacagccgcccagccccggggtctcagatgctcactggctcctccctgacctcccccccgggcaggcgagccctggcttctcctcacggtgcttcctggctgcagaccacaaccctccgctggtcgctggt

SEQ ID NO: 11554 - DNA, 453 bp, Homo sapiens
  ENST00000484861
tcacacactcacttacacctcccccagctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccagggccagccgggctcaggccccacctccctgccagtccttggacctcccagcccacccagcctcagcacagctcaacacagaaggagcagccccagccacagccgcccagccccggggtctcagatgctcactggctcctccctgacctcccccccgggcaggcgagccctggcttctcctcacggtgcttcctggctgcagaccacaaccctccgctggtcgctggt

SEQ ID NO: 11555 - DNA, 615 bp, Homo sapiens
  ENST00000616529
agctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgcctcctgtgtgtcccttctctgccgccctgtgtgctcccgcccggcctgctacagcttctcctcaggccagaagtccagctgctgacggtcatgtccc

SEQ ID NO: 11556 - DNA, 13912 bp, Homo sapiens
  ENST00000393437
cctccccagtcatttaggacaatttcctaagtcgaagctagagatgcgtgatgcgtttggtgacttttcctgggttcttgcttaagcggagccacaggttgtgggggcggccaggcctctggggaagagcaggtgccgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccagggcccgcgcggccgcaggtgcggcgcgtgaacgtggtgctgagcggcctgctggagaagtgcttcccggccgagtgccggctgcgcaggctggcaggccaggcgcggagcctgcagcgccagcagcagccggaggccgcgctgctcaggtgcgaccaggccctggagctggctcctgatgataattcattattgctgctgcgggcggagttatatttgaccatgaagaactatgagcaagctctccaagatgccagtgcagcttgtcagaatgaacctctcttgattaagggacatcaagtaaaagctcaggctctttctggattgggaagaagtaaggaagtgttaaaggaatttctctactgccttgctctgaatcctgaatgtaactctgtgaagaaagaagcacagaaggtaatgtgtgaagtgctgttttcagctacagcaaatgtgcatgaaaatttaacatcttccatccaaagcagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagattgctctttgaacctgtcactacgccctgtggacacacattttgcctaaaatgccttgagcgctgccttgaccacgccccacactgtcctttgtgcaaagacaaactttcggaattattggcaagcagaaactttaacataactgttctggccgaagaattaatatttcgatatttgccggatgaattgtctgataggaagagaatttatgatgaagaaatgtcagaactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgggatgtcaaacataaaaccaccaagtgcaaagaatgctttgaaagtagaaccttgtctcattgatcagtggttactaagcatttaggaaacagtcatctttttctattgggatttgcattagaaattagccccatcagtaaatttcagtttactatccatttattaatatacaaaaacattaaaaaatctgccatgccatggtaatctatctattccaggaaaatagatcagaatatatgaagggaggatggccggtatgggatgtaaatattcagtaagtttttctccaacaccaacctaaaattatctttatttttttgaaagaaagttttacggtgatcagaccaggtgttatctgttaaaggacagtagtatgacttccatcctgtaatgcacgttggtgatattgattggaataactgaatctgagatactcatatgttctctctggcccaaccagctggtgcatttggttggcttcctcgtctgtaaggtggacattcttaaccagagggtcacgaccacatcacagctgcaagttttgctttgttcattgaaggtgattttttagttttaaaatatatatatctcataatatacaatgttgatggtatatcaatccatcaagcattttattagaaagactttataatattattaatttttctttagttttcagtagataaagtagtttcagtagataaagactttataatattattaatttttcttttagttttcagtctcatcatgggagttagaaaataccagcatcacttaattgtaaagagaaaatgtgaaagtattttccaatccaatgtttcaagtgcctcacttattgtgaatctcaaatatcatcttgagatggtttaatggcagtttggccaagtgatttctaagagattttattaatttatgcattaacaatagtattcaactttcttaggcattataacctaacccgatcatttgattggaataactgaatcattcattgattggaataaaataaagaaaacaaaatgcatctcacatgccagaagacctttaccagaagtggttcatgaaaatcagtatgcattgaccattctctgcctttcccttttggaaaatttttttgtaccttcatatcacagctgaatagttatcaatgccatttccatttggaagtatctaaataaccacaatgtgatcacagcttctccacgagccttcctgaagtaaagctggtatgcttgctataatacttggaacctgttgctttctcttcctcactctttaaatgtcataaggtcacacagttcttggaatcagaactattcagttatttcttcatgattctgcctggctttctgagtcttctccttcggcatgttatgtaaaagtctgaacaacaatgatgacgcagacgagagcaacatacgtttttattttttgataggtttttatttttttgataccagagggaattaactatgatcacatcgtgctctctctgttcagcatcacacgcccacatactgcagtgtgggagtagattggtacttactgagcacttagaaacatcacgcatcaggaaccgggtcagggtgacagcatcctacggtcatatcatgaaggaagcctcccttacaaacctaaaaaaaaaaaaccccagcttcagtttgctaccaattaagctaaagcagaacggtctgcttcctcctccgcctgcccccttctgcctcttttctgttggggagatgccaattctaaggatttctcagaaaataatgtaatctctcattcaatgtcaggacattccagcttaattgtactgaaagtgctccaataggcatgctctcgttacattggaatcaaagcagaaaagagtaatagcagcgtgggggagtcatttttcttcttgaggaacaatacatgctgttctgtatttttccattcatcgcccaaacctgcctgtgtctttgaaatgcaagtaagatcccaaaggcagctttctgaaagcccgtggcatttttagcttatcccatcccccgtgtgtgtcctcatcttcagaattgaaagttaggatactttttaaagtttcaaaagaaaataatttaaaatgttaaggtttatccatagaaacacaataattcttaaccaattcatgtaccaaattcaacagtattatctcatttttagggtcacaaatgtgtcctttttgcacttaaacctcctccctctctcaaaaacaaaaacaaacaaacaaacaaaaaacacaccaagactgtttaacaaattgtatctcaactcttaatatatgttaagtcttaccacaggacatttgaatcatcaaggaacagttgaagtttatggatggtagaataacaatgaactatgatattatcactttattataaactttttggaaaattggcagttgctaccatcgaaatactccattgcctgtgttacatagaatttgttataatttttaagggctttaaaaaaatacccatctgtttcttctccttcttgttttcttttgtgccccaccacttaaattacttgggtaaataccactcttcaaaatttgaatactgtctatcaaataagaagaagtgtgaaagatatgaagaagaaaggtgatagcaaattagaagaaaataaatgtgggtgatttcttttagttgaaagcacagagttttatttttccccagtataactattgagtagggtagggaggtccctgtatccccatttttattttttttgagatggggtctcactctgtcacccaggctggagtgcaatggcgcaatctcgtctcaccacaacctccgcctcctgggttcaagtgattctcttgccttggccccctgagtagctgggattacaggcacgcgccaccacacccagctaatttttgtattttttttttttagtagagatggggtttcaccatgttggtcaggctggtctcgaactcctgaccccatgatctgcccgcctcggcctcccacagtgctgggattacaggcgtgagccaccgtgcccggcccatctccccatgttttagcatagacagcagcggcattcagtggaaggagttcttccccttcaacatcgtccttcccaaaggccacattctgattctattgttcaccaaaaactaattcccagggaagcccgctctggatgggaaggatgagctgcgtgagccatcgcccacacagggagataaccgaacccctttgccagcatcaccccctctctactggggtgagacacttcattcagagcactggctctgactcccaggggaaagtctttttccctttacaactcctcacctcagcctcaccttgactttcacttctcaactgctgaattctataaaatagccttttagcagtgactcagcttttaggtgagcacagataatgaagaaattgaagtgccaccattgcactcccccaagttggggacataaactcgaatttgcacccaggtctgataaaagtaactgattgaggacgcagaaaggtggatgccattgacagcgttgactgttctcacaattcctacagaaatgaaagaaggagaggcccagcagaccacaccgggccatgaggggaagcatgggagacaggcagaagcaggagtgaggaggaacgtggctcagaccctctactgtatgttctgcaggaaagggcagggaaatagctaagactggctggtctgaataacagctcagactctaggctatacaggtggtctctagccatctggcacctagccccgggtcgttagggtgggggatattgcttcctaggttgtaagagccagatagaggaggatgggctctggattggtcactttgctcccagggtagccctttgctgtatctaagaattggctcaccctgggatgggcagtttctcctgggtcagcgaggcccctgagatgtcaaaatatcataaaatatagaaatcatgattaatacaattggtcctctgctgttttgacatactaaggtcacttttgatagcagaaacttttaaagagtagggcatacgttgccctgaagagcatagaaaacattttattctgagagtagaaaggaggaagacacgtggagatacaggagtcccttaggctggcccatagctgagtctctcatgtgtgtggcattagtcaagaatgtagttctgcagtttgcggggggggggtctctaacatttcttggtgcagttgttaacatgtgttaaacatatgagtctgatgatgatatcgcggtgtttctcggctcggggtggcaggtctggcggttgtgtggctgggggtgtgcactgatagttcagtaaaggataagtagagactcgtggtgttcatgtgtcaccacagggagggagtggctgtggagacccaggacaggaagtcgcggtggaaagcaggctggggtggtaggagaaggcaccgggggtgggtgctcctcccccaggggttgaggagttgactgatagggggcagttacctcctgggaaagcaagacgctcccttaagttttagaatggtacagagagtagtcccttctaccagagtttccatttagacatgggagtgtagggggccatgtttcggcagaagcagggcatgtatcagcattagtggactcctcagtattaaaaggaagaacagcaaacatgtcatgtgcccactttgtgcctcaggagaggtagcccgtggacatcgctagggcagaggttttaatatctgggacaaagttatctcccacggcgaggtcgtggctgggaccatgtcatcttcagccgtgagctgctgggctgggcaatgtcttctgggatgtgagacgtggggtctcctttctaagcggacccccactcgtgctgatgtgggtcccagcatttgccgcgtttggttgaaacagtggcttacctggagggtctgggtctctggatcataaaccagcgaaagcccccacatcagtggtgacaagatcaatagaccccagaatgtgtgcagctgtgcttgatagggttttggttcttgctttttggtggaagtttaggctcaagtgggtcccgtatcggatgagcagctgcacggcctgtgggagccctggggttagtgggtccaggagagaatgtgttctctctctgggctccagccctgatggggtggggataagatgcaagatttataggaatagggggaaacattatggaaggccccaatatgtaatgagcttttatatacaagaatgcaagacatagccctctttttatgtttaaaggggactatggtaatgttttttaaagtttgtgtgaggtgtgagtcaaccgaaaggccctaaattaagagagattcaggtttgtggtgcaagatagaggcccatttcggggtctgtttgcagaccagaatttgaaatggagttgtttgaggagaccattgtgtgtcttcgtgaaaccgattgtgtggaacctatcagggctgtggaagttgtagcgaatgccttttcccagagcccagcattgtggattccgagaagtggcatgtgtgtctcagtgacttccagtgatgcctgccactctgaagagatgaaggagtgtcctggcaagacctggaatcccagctgtagcacctgtggagagatgtgatttagatttggatttggggtatctgtgaggaagagtcccagagtttttcatcctgaagggggcaactcttgggcagtggtccaacagttggccataaatgtgaagctggggcgctgtgctgaccagggcatccagcgttaagacgactgcctaactttggccacatgcgttgttttttgggttccgtttcgtatcagggcatgctggctaaaagatgggaagcagcaacattctcttgggctccatcatttatatgagggttggcaatgccatctgtaccctctgtgaactcccactgctgttcactcagttaatctaagggacaccaaggggtctgcgggaggatgacctcacaagggactgaggacatgggagaccaccctcctgtgggtagaatacaccagagggcccaggcttgactctgtcctgtgttaaggaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagcagcagcaagaagattaagtaaaatttgtaaatgaggactacattgccatcagaacctcgaaagtatctaaagatgttggacttgtatgtccttaatgagtgtgacaatgagtttcctcatttgtgctcctggagaaggcggatgtggtgaagaccctgtctgcagacattgtgtgccatggcaaagccgtggagctccctgtgggtggcctgcaaaggtgtatgtgcccctcagggcagaaggcaaacggcagccaagaagctgtgcaagtagacacttaatgggacatgttagccaaatctgtaagagcaaaatattggccagttatttattgtgtagaattaataattttaataataatggaaattgggtaatggatgggactgcagcaataaggttgtagtaatccaccatgaggcacacttgtttttttccaggtttaaggataggaaagattgggctgttcaatggagaaacaagggtataatcacccctttattaattagtaagttttaatccttgaatacctcatattaactgttttaactggaggtccatggggcatcattttatcaagctagtttataactgccaaagactgactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcgttggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccggccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaataggctagactgatgagaaattagatcaaatcagtgcctaggcctttgtgtttgtgtcgtagggatgtactaacacatcaccacagactgacggcttttcacaataaatcagttttcttcgctca

SEQ ID NO: 11557 - DNA, 2363 bp, Homo sapiens
  ENST00000409647
agtggcagtctgtttttcttgctcctgatgataattcattattgctgctgcgggcggagttatatttgaccatgaagaactatgagcaagctctccaagatgccagtgcagcttgtcagaatgaacctctcttgattaagggacatcaagtaaaagctcaggctctttctggattgggaagaagtaaggaagtgttaaaggaatttctctactgccttgctctgaatcctgaatgtaactctgtgaagaaagaagcacagaaggtaatgtgtgaagtgctgttttcagctacagcaaatgtgcatgaaaatttaacatcttccatccaaagcagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagattgctctttgaacctgtcactacgccctgtggacacacattttgcctaaaatgccttgagcgctgccttgaccacgccccacactgtcctttgtgcaaagacaaactttcggaattattggcaagcagaaactttaacataactgttctggccgaagaattaatatttcgatatttgccggatgaattgtctgataggaagagaatttatgatgaagaaatgtcagaactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgc

SEQ ID NO: 11558 - DNA, 3549 bp, Homo sapiens
  ENST00000389131
acaacaaaagaggccggaggccgggcctgctgcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagagaacctgaatatccaggtggaggacattcggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaaaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaaccgcccctgacctggtcctcaatgcggagatggtgcagcagaccacctacctggaggaccggcccatgttcatgctgcagtgtgccatggaggagaactgcctctcggcctcagccgcgcagaccgaccccaccacgggctaccgccggctcctgcgcttctcctcccagatccacaacaatggccagtccgacttccggcccaagaacggccgccacgcgtggatctggcacgactgtcacaggcactaccacagcatggaggtgttcacccactatgacctgctgaacctcaatggcaccaaggtggcagagggccacaaggccagcttctgcttggaggacacagaatgtgaaggagacatccagaagaattacgagtgtgccaacttcggcgatcagggcatcaccatgggctgctgggacatgtaccgccatgacatcgactgccagtgggttgacatcactgacgtgccccctggagactacctgttccaggttgttattaaccccaacttcgaggttgcagaatccgattactccaacaacatcatgaaatgcaggagccgctatgacggccaccgcatctggatgtacaactgccacataggtggttccttcagcgaagagacggaaaaaaagtttgagcacttcagcgggctcttaaacaaccagctgtccccgcagtaaagaagcctgcgtggtcaactcctgtcttcaggccacaccacatcttccatgggacttccccccaacaactgagtctgaacgaatgccacgtgccctcacccagcccggcccccaccctgtccagacccctacagctgtgtctaagctcaggaggaaagggaccctcccatcattcatggggggctgctacctgacccttggggcctgagaaggccttgcgggggtggggtttgtccacagagctgctggagcagcaccaagagccagtcttgaccgggatgaggcccacagacaggttgtcatcagcttgtcccattcaagccaccgagctcaccacagacacagtggagccgcgctcttctccagtgacacgtggacaaatgcgggctcatcagcccccccagagagggtcaggccgaaccccatttctcctcctcttaggtcattttcagcaaacttgaatatctagacctctcttccaatgaaaccctccagtctattatagtcacatagataatggtgccacgtgttttctgatttggtgagctcagacttggtgcttccctatccacagcccccaccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgggtgacagggcgctcactgagcaccatgtgtcatcacagacacttacacatacttgaaacttggaataaaagaaaga

SEQ ID NO: 11559 - DNA, 502 bp, Homo sapiens
  ENST00000520617
gctggtggagagaaacgggtcccttgtgtgggggatggtgtgtggccaaaactggggcatcgtggaggccatggtggtctgccgccagctgggcctgggattcgccagcaacgccttccaggagacctggtattggcacggagatgtcaacagcaacaaagtggtcatgagtggagtgaagtgctcgggaacggagctgtccctggcgcactgccgccacgacggggaggacgtggcctgcccccagggcggagtgcagtacggggccggagttgcctgctcagaaagtgagagctcctcccctccctccccaccgggctcccaaggggaccagagtcccaccagttattcctcaagagactctgaagccttgccatgagccaagcaatagaggaaggtagaatgaaatcctaagggagaaaaactgggggcaagagagatgaccgccaccccaaccacagatcgctgtctatgatgtagtggggagaaaagcgggagggag

SEQ ID NO: 11560 - DNA, 559 bp, Homo sapiens
  ENST00000523833
aaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcacctggtattggcacggagatgtcaacagcaacaaagtggtcatgagtggagtgaagtgctcgggaacggagctgtccctggcgcactgccgccacgacggggaggacgtggcctgcccccagggcgg

SEQ ID NO: 11561 - DNA, 620 bp, Homo sapiens
  ENST00000520349
gcgagaatgggctaccggccgtggtgagttgtgtgcctgggcaggtcttcagccctgacggaccctcaagattccggaaagcgtacaagccagagcaggaccgtgtgtctcttcagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccag

SEQ ID NO: 11562 - DNA, 689 bp, Homo sapiens
  ENST00000518878
cggattcgagccatcctctcaacctaccgcaagcgcaccccagtgatggagggctacgtggaggtgaaggagggcaagacctggaagcagatctgtgacaagcactggacggccaagaattcccgcgtggtctgcggcatgtttggcttccctggggagaggacatacaataccaaagtgtacaacaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtctgccgccagctgggcctgggattcgccagcaacgccttccag

SEQ ID NO: 11563 - DNA, 665 bp, Homo sapiens
  ENST00000522446
cccacaccccaacacacccacgacacacacacacacacacacacacacacacacacacatccatacatcaagcatagttgcagctcccagactgagtgcctggcctgggaacagggtggcagggaagggagggggcggggacagtggtcacccgctgaacgtgcatcagcgtctgtactcagcaggaccgtgtgtctcttcagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtggccaaaactggggcatcgtggaggccatggtggtc

SEQ ID NO: 11564 - DNA, 571 bp, Homo sapiens
  ENST00000519809
ccagtgcctgcctagtactttggagtctctgcaggcctagactgtagcactgtgttataagcaaggttgatccaaacttgcttagaagcaaccttgttacaagaaagaattattatccatttggaatctgcagactttggaggcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaagctgcgcctgaacggcggccgcaatccctacgagggccgagtggaggtgctggtggagagaaacgggtcccttgtgtgggggatggtgtgtgg

SEQ ID NO: 11565 - DNA, 965 bp, Homo sapiens
  ENST00000520925
ccatcgtctgcagaatgtttgcctcacggaggaagcagcgctactggccattctccatggactgcaccggcacagaggcccacatctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagagcaacccctggtgcgactgagaggcggtgcctacatcggggagggccgcgtggaggtgctcaaaaatggagaatgggggaccgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccatgggcttgcagaagaaggtgatgggactggacacctagaggggactgtaactgaggctgcagaaagtatagccacagagctctggggtgaaccctggaagtgaccaggtgctgctgctagtactgctgcagacattgccacttggcatttgcaatgtttagttccccctcgaacctcgggcctggccctggcccggcagcaggcccaagcccctgtgtgcagtgtgagctggaaaggccctgcctccttgcatgttaacatctgaggtgagttacctcacctctgccccaccacctccaaagacaggcgtgggaccggctagccacaaccttatcaaaacacggtgcagcctggctgtgctctgctggctggaggcgttctctttcctctattcatgttcagaaaaaaac

SEQ ID NO: 11566 - DNA, 725 bp, Homo sapiens
  ENST00000518472
atctccagctgcaagctgggcccccaggtgtcactggaccccatgaagaatgtcacctgcgagaatgggctaccggccgtggtgagttgtgtgcctgggcaggtcttcagccctgacggaccctcaagattccggaaagcgtacaagccagaggctggagtgcaatggcatgatcttggttcactgcaacctccggctcctgggttcacgcgattctcctgcctcggcctcccaagtagctgagatgacaggcacccgccaccacgcctcgctaatttttgtatttttagtagagatggggtttcaccatgttggccaggctagtcttgaactcctgacctcagatggcccacccgcctcagcctcccaaagtgctgggattacagatgtgagcccactggccgatttcctagaacaagtaaagtagtccaaccacagcaggcttgacccagcctctgacaaagagcaaatgccctatctgtctcttcttgattcgcttttctttctcctcctcttcctttttcctgtatccatcaaagggtctctgtgatttctgtgttcaggaaacagcgaatatcttgtgagtgggtgggaatagcaactgggaagaggagagggagggataggagaagtgaccgatcatttctcaggggctgatgccctgtgccaggtaaaacctcagtacttagtgcactgtttgctgacgcggcatgagtagatgagac

SEQ ID NO: 11567 - DNA, 975 bp, Homo sapiens
  ENST00000524144
cctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagag

SEQ ID NO: 11568 - DNA, 892 bp, Homo sapiens
  ENST00000520871
gaattgccagacttcaagtgctggcagtgatgcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagag

SEQ ID NO: 11569 - DNA, 588 bp, Homo sapiens
  ENST00000518083
tatttgtgttgaggggaccagctgttagtctttctgctgctctttctaagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacctccaatggctggggcgtcactgactgcaagcacacgga

SEQ ID NO: 11570 - DNA, 746 bp, Homo sapiens
  ENST00000524168
cagccatcggagaccagagccgccccctctgctcgagaaaggggctcagcggcggcggaagcggagggggaccaccgtggagagcgcggtcccagcccggccactgcggatccctgaaaccaaatggagtctcgctctgtcacccaggctggagtacagtggcacgatcttggctgactgcaagctttgcctcccgggttcaagcgattctcctgcctcaagcctcctgagtaactgggactacagaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgtctgccgggagctgggctacgtggaggccaagtcctggactgccagctcctcctacggcaagggagaagggcccatctggttagacaatctccactgtactggcaacgaggcgacccttgcagcatgcacc

SEQ ID NO: 11571 - DNA, 763 bp, Homo sapiens
  ENST00000519243
cggaggccgggcctgctgcggcggccgccttcggggaagggggtgggtccggggaggggtttgccatcctcctctagttaaaagtaagggggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgaaaccaagttctgaactcccggtctccccagtccctggaggctgcctgcagctttgcttagcttctcagcctgttgatcactgccgtggaattggcgagtatcttccgggggaaagcagagacaaaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccattaccccgagtacttccagcaaccggctcctgagtatcaccagccccaggcccccgccaacgtggccaagattcagctgcgcctggctgggcagaagaggaagcacagcgagggccgggtggaggtgtactatgatggccagtggggcaccgtgtgcgatgacgacttctccatccacgctgcccacgtcgt

SEQ ID NO: 11572 - DNA, 419 bp, Homo sapiens
  ENST00000524075
tgatgcggggcctggacttcaatattgctggtggtggtgcaaactgcaatgcgtaccccagaagggaagctggcagcttaaaagttagcagcgtgtgtgccctttgattcagagagccacttgcgcgtggctctccggagagatttctacctgggtccatgaatggacttacggaaggattccttggtaatgattctgagtgactgtgttgatggaggcaagcaaggtcttggacaagtcaaaggcggcagccatcggagaccagagccgccccctctgctcgagaaaggggctcagcggcggcggaagcggagggggaccaccgtggagagcgcggtcccagcccggccactgcggatccctgaaaccaagtaagagcgcttcccgcgccaccccctccccgaagcggttcgcgagaa

SEQ ID NO: 11573 - DNA, 3637 bp, Homo sapiens
  ENST00000374431
gtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacgtactttatacaaaatacagaatactttatattggaagtgaaagaaatgaacgtggacttttacacatgtgcatatttttctggaggctatatggattatttgaaatgaaaagcatactaattggactttaataaatcattttcaatca

SEQ ID NO: 11574 - DNA, 2993 bp, Homo sapiens
  ENST00000374430
agaaagcagggctgcatggtgtggggatgctgctgctactcattcctgctcattccagtgttctggaaaatgaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcata

SEQ ID NO: 11575 - DNA, 2687 bp, Homo sapiens
  ENST00000358883
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgt

SEQ ID NO: 11576 - DNA, 1019 bp, Homo sapiens
  ENST00000441240
ctggcggctgacgctccctgagtggcgactccgtctccagccccgctgcggagcgcgggccggatctggggcggccagggcccggagccgcggagccctccccgccgcccggccgagcacgggaccccggcggggtgggcgcagggggcggccccgctctgggcgactgccgaggggcgggcggagggccgggctcggctggcggtggggcgggggccgccgggactgggcgcgcggcctgaagccagcccgggggcggcaggagagggacgcgcggcggcagcgagcgcaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctataccc

SEQ ID NO: 11577 - DNA, 2490 bp, Homo sapiens
  ENST00000541779
ctcaagggaacagctcctgcccaggtctgtgggcactcagcatggatttcagtctccctgtgagtgatgggaaagaactaacagaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagtgggaggtgatttcttctttggcgagagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcatt

SEQ ID NO: 11578 - DNA, 5391 bp, Homo sapiens
  ENST00000262134
agagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaacaaaaatgatagattttcttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttgcccaaagtagcaatattcttaaagatgttgaattttgactggttgaattttatatagtaacacacaagtcgtgatcatcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattcaaaatacatatcacaaactttggtaaataggatagtaatctgaagaacttttgccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtccagaattta

SEQ ID NO: 11579 - DNA, 832 bp, Homo sapiens
  ENST00000566911
agaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggtaagaaataattttgtccaaaatattaggacataatattaaattaagatatactaaatcaatataagaagagttcatcatagtttagtcagtgatctaactgctgttagataaaactattttatctgcctactcaataataaattttacagttttatctgcctactcaataataaataatttatttttatttctcatatgaaatacgtagaaattactgcccaaatgccaactacattatgataatcttctaaaagttataattgcctaatgttaaaatattttgttttctgagttattgccaaatgcgatacatccctagttcggaaagatacccaactactatacttgaaaccactgaagctacaaaataccttgctctcagttttcacatttgcttttctccctcta

SEQ ID NO: 11580 - DNA, 616 bp, Homo sapiens
  ENST00000564084
ctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagatgtttctgttcttttgggaaggaagcagcaagcattgtttaaaaatatcttccttcttttgcattttttctcttcgaagatttaaaagaagaattacacaaagaactagaactgcacatttgttaagattgtccttttaaaattattttctgttacaaggaaaaaataaaagattgattatagtgtcata

SEQ ID NO: 11581 - DNA, 5285 bp, Homo sapiens
  ENST00000566915
gaaatacacaaaataactctttagcttgctctgagcatttttttcttttctgatagcaactttttaacgttgtggatccacagaacttactgctttgctttctcttttggggtcataattcctctccccttggagtgtccactccatgcatgtgcacttaggatgtgtggctgtgtgtgtgtttgggaaccctcacggacacataaggttctatgtcatcaagtagaaaacctatctcattatcattataatgtcttcagatgctttctaaggttcacctcttttttaacattagaagtcagtgaatgcagctttcattataatttttaatactttaaaatgtttttgtattagctgccagaatgctcagcagcaaagttatgactcacttctagcaagtgtggtagttcttgcttcaagcatttggtttcatgtagcttttcttcttattttttctttgtcttgattttatcattacttaaaacaattctgttgaatattaacacttggaaaatgaaaaaaagtggagaaataaatcaatgaataaacaaatattttaagtggcataggcacagcatttaatattttgcttcagtagttcttaattaaaaaaaaaaaatccctcattttggtaagcactagggatttaccaacatttagcaaatgatttctgttacacatactcttaaaatattcagtctatttatactatttattaattttctctttatcataaaacttttattcacataaaaacacattataaactttcaatgtggttgcaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaacaaaaatgatagattttcttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttgcccaaagtagcaatattcttaaagatgttgaattttgactggttgaattttatatagtaacacacaagtcgtgatcatcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattcaaaatacatatcacaaactttggtaaataggatagtaatctgaagaacttttgccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtccagaa

SEQ ID NO: 11582 - DNA, 712 bp, Homo sapiens
  ENST00000563095
gtgatcttagccctctttttagagttgaaatggttcatcaaagttaaatgacatactagttaacacacaagcagacccagggcttagaaacagatctcctgagtacaagcccagtgccccattacctcatataacctatgttctagaaaggtagatgattcaatatattgataatgtataaattaatttacttggcatttaatgtcttaggcttaagacattgttatggaaaggtatatttgtctttcagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaag

SEQ ID NO: 11583 - DNA, 482 bp, Homo sapiens
  ENST00000566375
cctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacagggtatgttaaaatttaatctttcacatttttactctgtcagtcctacagtgagtaaatcaatatggtaggcaatttgaaaaacttgataggtcagtgttagaagaatcaaggctgagcctatggtttaattgcatgattttgtttttttctccttaatagtaatattaataattgtgtgtgtgtattgtaacatttattatactgtcatatataataaaatatcatatcata

SEQ ID NO: 11584 - DNA, 423 bp, Homo sapiens
  ENST00000565056
actagagataacaattggcccaggcagttggaagactggtgagcctttgcagcctatttggttaccgcattttcgcatgaactgatttgaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaag

SEQ ID NO: 11585 - DNA, 551 bp, Homo sapiens
  ENST00000562299
atgtttgaattattaaagactttattttccaagattattccctaccactatgatcctgagggagctaattcttacattttattttcttcagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaacaaaaatgatagattttcttact

SEQ ID NO: 11586 - DNA, 2262 bp, Homo sapiens
  ENST00000314891
ggcgccctgacaacgcgggcgggctgggctgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccagtcatattgatgttaccattacttgggaaggaaagggatgaatggttgtaggacgcccgttggaaaatcacaaatgtttccaaggttcgtcctcttggccatagctggatgaatcttcctcttcggacagggctctttcctgcacagaaatcatactgaggttccatatcctccctcctgctgtcatctcctatatgtacattttaacagacttcctcgtgaacctcttttcagcccattccctcttgctctgtcctcattaaagattaaaaaatagcttgctaccattcc

SEQ ID NO: 11587 - DNA, 1357 bp, Homo sapiens
  ENST00000563748
ttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 11588 - DNA, 672 bp, Homo sapiens
  ENST00000567507
ttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcag

SEQ ID NO: 11589 - DNA, 939 bp, Homo sapiens
  ENST00000563240
gggaaggagcccatagttagagattggtgagtatcgaaatctctcttctcttagactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggtaaaggagctggaacaaagagcagagcagaacccaggcttccctccaggctgacatgttcctagtggccgtatcagtcactcacagtttggagtcctcagtggatgttctcacagctgttgttagatggccatcccctgagatccactgaagattcattttttaatcaggcatccagtgcattgaagagcaatgttatcatcatgaggaggaacaagggagaaataatcagtaaggactataaatttctgaaaccactttagagagtggcgaaggtggggaatcataagaccttttggggtgctgggtgagggtctttgaaggagagtcatgaaggttacgtgggaagatgacatgtagaagaaacaacaccggacagttagatggttgagagcttgagacccagctatatctgtaggacttgggcagattattttaaatatcctatagcttctctagaggaattttctcaagattcttagcaagcc

SEQ ID NO: 11590 - DNA, 577 bp, Homo sapiens
  ENST00000562404
gggggtggaaatgggatttaggagccttcatcgcaggggtgcctgtgcagcctgtcctcatccgctaccccaacagtctggtgagtcttagtccaagaaagagtggaaagggggagcacaaatccaccccaaatggaaataagtgaaaactgttggtgctttaatgggatgtgcattgggggctgtgaccagaggtgggatcaggccctctgttcaaaggtgattggccagttccagggggaaaaagtaatgctcttatgccctcacctgtgtttctcccataggacaccaccagctgggcatggaggggtcctggagtactcaaagtcctctggctcacagcctctcagccctgcagcattgtggatgtggaggtatggctcccgtgggggcggtgggagaagtacatctcagactcctgaaaccttgggaaaagagggtgggagtggtcatacctcactttgaggttctgataagaattgtgtgtgtctgtgtttcagttccttcctgtgtatcaccccagccctgaggagagcagggaccccaccctctatgccaacaatgttcagagggtcat

SEQ ID NO: 11591 - DNA, 915 bp, Homo sapiens
  ENST00000566581
gctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgggtaagggtctcaagaccatcttctcactttccatgtgctcctgaagaggcttccctttcctctctccacagccttcttcagtcttcttcacctcattctgctcttttttaccccaggtgctattctttcctgagggcacctgttccaacaagaaggctttgcttaagttcaaaccaggtgaataaaatgatagtgggtggtgggctgtaggaaaaagaagttccagatttggggagggactctg

SEQ ID NO: 11592 - DNA, 1349 bp, Homo sapiens
  ENST00000623384
gttttataaatggggtagggaccaactgaaagacaggaaaataaggcccttgatgccattaatcttttatcctcttgccctcattggtatcttcatcccaccttgggtcccagtcccctctcctgttcccacaccacctgtcacatgcaagggatgatggctgtctgctcctgggtctatgctttgtggaagaaggatgctgtggagggagcatatccaagctctaaagtggcattctctcccaccctttgcagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagtaagtgagggatcagcccccagagaccctacttctcttccctgctgtctattcggctccctctttgagaagaagaaaagagagcattctgaaactattctgtctagcttgggtagatgagatgagtcagccaagctcagacgtggttcccagacctcacctctaagtaatgtgccctgataggtcccaaagtggccagagaccttggccccttggtcacatcctatttaagggtaaaagaggggtgccctactttcccggtgtctgaacctgggggcgggtgagggttagaaccactgcttccgctgatacccagccttgccctggcaggactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggaggtgagagagttcaaagggggtgaagggcagggtgacaactctgggcaaaaaaagtcaggaatggagacactggagtgaagaactggcctcaaagtggggagggactgttggcaagtgaaatataaattaacaccattagtcaaccagtcttagattctgagggctgggacagagagaaggtgttggagggagttctggtcagttctctaaaaggacaactactataaagggattgtcccagggcaaagataacaggccaggcacggtggctcgcgcctataatcccagcacgttgggaggccaaggcgggcggatcacctgaggtcgggagttcgagaccagcctgaccaacatggagaaaccctgtctctactaaaaatacaaaaaaagtagccgggcgt

SEQ ID NO: 11593 - DNA, 657 bp, Homo sapiens
  ENST00000569804
ttaaatcctctaagtgctagatgctttttatggctttcggttttataaatggggtagggaccaactgaaagacaggaaaataaggcccttgatgccattaatcttttatcctcttgccctcattggtatcttcatcccaccttgggtcccagtcccctctcctgttcccacaccacctgtcacatgcaagggatgatggctgtctgctcctgggtctatgctttgtggaagaaggatgctgtggagggagcatatccaagctctaaagtggcattctctcccaccctttgcagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggag

SEQ ID NO: 11594 - DNA, 341 bp, Homo sapiens
  ENST00000562431
gtgtggggagcgggcgtcggaaggacccgtgaggataggaaaatggggccatttgagccctggcaaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacac

SEQ ID NO: 11595 - DNA, 1719 bp, Homo sapiens
  ENST00000617710
cagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaagcgggccacctcaggaggcaagtggccgcagtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctatt

SEQ ID NO: 11596 - DNA, 560 bp, Homo sapiens
  ENST00000520959
aacagtttgtatgctggaagagttctgaaaagatctctgagggctggaagtgctaaggacaatttcataaagaagaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtat

SEQ ID NO: 11597 - DNA, 629 bp, Homo sapiens
  ENST00000524029
gacaaacaggattcgtcaaaagagaggtgtattaaagtgccgatcaaatgtaatttaacagctaaactttccctccttggaaaacagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaact

SEQ ID NO: 11598 - DNA, 559 bp, Homo sapiens
  ENST00000522701
aaactttccctccttggaaaacagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactc

SEQ ID NO: 11599 - DNA, 3846 bp, Homo sapiens
  ENST00000311322
tttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccac

SEQ ID NO: 11600 - DNA, 554 bp, Homo sapiens
  ENST00000519773
agactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccttattttgaagttacagatttttaaattttgagttgaaaaaaaagagcaaatttagattaaggaatgagaagtagtcctcgcagcctcatgaatctcctgaaatttcgaacggcaaaatctaaaatctacaagttattaccttcttacagtaaatagaaagaagagattttatcgacatcgaaagtaaatttgccctaaggacccctgaagacacagctgaggacacttgccacctcattcccggagtagcagagtccgtggctacctgtcatttcaatca

SEQ ID NO: 11601 - DNA, 566 bp, Homo sapiens
  ENST00000521994
agactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtgtattgggctgatgtatctatgacaagtggtaggtgggtattttaagaaagcttgtgtcatcatcttcaggtaacaggaatgtatgagagttgggtgccaaaacttgtggccgccctgtacaagagagaa

SEQ ID NO: 11602 - DNA, 463 bp, Homo sapiens
  ENST00000523696
agcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaagggaggctctttggggaagagtggattggggtggtgaggtatcctgactggcctgcccaattgttggggacccagtgatgggtccgcaccccacatctcacgtggatctccttacacttgaataaagacagttctggctca

SEQ ID NO: 11603 - DNA, 5835 bp, Homo sapiens
  ENST00000448637
atttctcttccgagagcttcagtttcctcacgtgccaagcggacgggttggaagttggtctttgccagctctgacaccttcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacaga

SEQ ID NO: 11604 - DNA, 612 bp, Homo sapiens
  ENST00000416784
ggggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctct

SEQ ID NO: 11605 - DNA, 521 bp, Homo sapiens
  ENST00000430340
gaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtgggaactttgaggctcagagacagagcagaagacagaacctggtcttctgattccctgtgttctgcttttttcattgttccactggacgctcatcagagggaagatctttttcctcaattgggacatggatgaacctggaaaccatcattctcagcaaactatcgcaaggacagaaaaccaaagaccgcatgttcttactcacagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacc

SEQ ID NO: 11606 - DNA, 502 bp, Homo sapiens
  ENST00000414139
actttttgtctgtgggttcgttcccgggtcccgcgcgagctttcccgggataagtagctttagcgatcgggagacagccgggcgctgcaaggtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacct

SEQ ID NO: 11607 - DNA, 343 bp, Homo sapiens
  ENST00000454789
gtgggttcgttcccgggtcccgcgcgagctttcccgggataagtagctttagcgatcgggagacagccgggcgctgcaagcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtga

SEQ ID NO: 11608 - DNA, 386 bp, Homo sapiens
  ENST00000426274
aggaattgaagagaatcctgacaagtggcatgttgggaaaggcctgaaggaagccagaccagcttgctctcagagctccttgggtcccctgcggcccccaggtgatcttcagcaagacctgcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgatt

SEQ ID NO: 11609 - DNA, 535 bp, Homo sapiens
  ENST00000420410
cccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgagga

SEQ ID NO: 11610 - DNA, 400 bp, Homo sapiens
  ENST00000443217
aatgtctcagttctgttcccttcaggcttcgagaccaccgccttgctgtgtcccgtagtggactgagggcctgcaagagggagtgagggctagtggagggccagctgcctgtgggggctggacatcgtgtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgcccc

SEQ ID NO: 11611 - DNA, 18277 bp, Homo sapiens
  ENST00000618621
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 11612 - DNA, 479 bp, Homo sapiens
  ENST00000457242
gatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaaccca

SEQ ID NO: 11613 - DNA, 412 bp, Homo sapiens
  ENST00000494233
cattgcagttggctgaaccttgtgtcaaccatccattccaggagccagctatctgaggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccaca

SEQ ID NO: 11614 - DNA, 499 bp, Homo sapiens
  ENST00000474472
agaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacag

SEQ ID NO: 11615 - DNA, 578 bp, Homo sapiens
  ENST00000484468
aggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacat

SEQ ID NO: 11616 - DNA, 564 bp, Homo sapiens
  ENST00000462758
tttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactgagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatg

SEQ ID NO: 11617 - DNA, 998 bp, Homo sapiens
  ENST00000471917
cagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacc

SEQ ID NO: 11618 - DNA, 582 bp, Homo sapiens
  ENST00000487347
atttacacttgcaggctgttatgctttccagaaaactttttccgtaggttgcgaaagtgattaatctgctgttaaaactgacaaagaaggttctctgataagagaaagaattaaatgaggaatttttctttaaaaaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaa

SEQ ID NO: 11619 - DNA, 888 bp, Homo sapiens
  ENST00000415906
atggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttgaatgctgataatgccaagctgtgtttacagtccaaatttttgctgaagaccttcaactttgcactctccctgtgtggtatctcttgcccaagacagaacttcaaataaaatcacatagctgatgcaagaaaccgtta

SEQ ID NO: 11620 - DNA, 368 bp, Homo sapiens
  ENST00000483938
atacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtatagaatgctgataatgccaagctgtgtttacagtccaaatttttgctgaagaccttcaactttgcactctccctgtgtggtatctcttgcccaagacagaacttcaaataaaatcacatagctgatgcaagaaa

SEQ ID NO: 11621 - DNA, 300 bp, Homo sapiens
  ENST00000494044
aatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtgaatgctgataatgccaagctgtgtttacagtccaaatttttgctgaagaccttcaactttgcactctccctgtgtggtatctcttgcccaagacagaacttcaaataaaatcacatagctgatgcaa

SEQ ID NO: 11622 - DNA, 548 bp, Homo sapiens
  ENST00000459897
gttaatcctgatgcacagaactgggaataggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccg

SEQ ID NO: 11623 - DNA, 18277 bp, Homo sapiens; identical to SEQ ID NO: 11611
  ENST00000640853

SEQ ID NO: 11624 - DNA, 18220 bp, Homo sapiens
  ENST00000617246
gtgggaactttgaggctcagagacagagcagaagacagaacctggtcttctgattccctgtgttctgcttttttcattgttccactggacgctcatcagagggaagatctttttcctcaattgcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 11625 - DNA, 4710 bp, Homo sapiens
  ENST00000311191
ccgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcgttatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaatcttggatttgtacaa

SEQ ID NO: 11626 - DNA, 2070 bp, Homo sapiens
  ENST00000443945
gcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtaaggctgctggtagattcaccagaactctgtgcaatattttgccatggaatactggccaccacattctgtaaagatttgtcagggagtgaaacatctttattaatgaggccaatattcagatttgttcaggacacatttttcaacttgtttatacgtttgcctctttagttctgcttttctgctatacctcaccctctgttgaagatgagagttggctatttctattagattctgtagatttttttacctcagatcatcttgctgagtcaagcgatggcaactaaaatacatagggaatctgcctgtgtgtcag

SEQ ID NO: 11627 - DNA, 4131 bp, Homo sapiens
  ENST00000389798
cttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcaagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgatt

SEQ ID NO: 11628 - DNA, 3314 bp, Homo sapiens
  ENST00000389797
acaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagacccagccctcattcttcctcctatctccttcaacacacttacacaggcacagacatgggacagctctagctacagtgttccatctgaaggagacagtgacaatgtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcaagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtga

SEQ ID NO: 11629 - DNA, 554 bp, Homo sapiens
  ENST00000463929
atcgggtggtatccattgagcactgtcctggtgaggacaggttgatagatcacctgaagccttttagatgagaccaggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtca

SEQ ID NO: 11630 - DNA, 545 bp, Homo sapiens
  ENST00000478412
gaaacgaggctctgctgccttctatggtgaaaggggagagcttttccaggttcaaaagtaaagcgggatatttaaggccttgatctcactggaatcatttgtatctttagttctgtgatgccaagtgggacctgcatgggatttggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaa

SEQ ID NO: 11631 - DNA, 5273 bp, Homo sapiens
  ENST00000273261
gctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 11632 - DNA, 5283 bp, Homo sapiens
  ENST00000383703
gattgttcggctgcgaggtcggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctccttttattagagccatcccagtctgctggctgcagctccccgtcccagccccatatgtctgctgggggaaggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 11633 - DNA, 4129 bp, Homo sapiens
  ENST00000496559
actatttgaccttcctgctgtgacaagaaaggtcaccgccagcatttcactcttcagtcagagctgccctctctgctggcagcattgattcctgctgcagcttctcacaggagacaagagttccttttctctccctggcctgtgtctgcaagggctcggggggaaaatttaagaaccaagaaccttgtggaaagttggagagggcaggatgggggcctggtctccaggtgtgatgtctcgcctgggcactgtgacctgctcctggaagctgggaagccattgagtcatcggccatgggatttgcattgttggaggggcctgggctgagttggcctcatccctctgatcctggcgagtgggtcacaagtctgactcagcacccagatgtcctccctggctcagagtcagcgccctgcaggccttgggaggagatgggctccgggctccagacccactggctgggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtc

SEQ ID NO: 11634 - DNA, 2336 bp, Homo sapiens
  ENST00000495037
attattactgtttactagcagctcggagggaagactggaggagggcaagacagagaggacggctgccgctcgattcccccagcccgtccccagtgacggggagctcagcagagtgcgagtgtcaagtaaatatttggaaagccctagtggagctcgatgatagaggagagcctgtggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctac

SEQ ID NO: 11635 - DNA, 580 bp, Homo sapiens
  ENST00000491821
gaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttgtaagtgtcctcggctctgggctgtggcagtgtttttagacactgcttggaggtgaaagtgctaggcctggttcgttccaccacacagtggcctcggggagggctcagagacaggccagtagccctgttcccaaaccagccaggcccagggtggaaccctcagcgatttgagccccagtcccttcctcatctccccttcacttcctctgcatttggattagcaggggctccaggagtagcagctaggtccctgcagggagccttggcccccaaggtcctgttgggtttggagacagttccaggggtagaaagttcctggggaagggcagctatggcagagtgctcacaggagccattttgagagtgactgtgtgt

SEQ ID NO: 11636 - DNA, 598 bp, Homo sapiens
  ENST00000497721
gagttggactggagctgtctggctgcacaggacagggcacatcctttatggcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagct

SEQ ID NO: 11637 - DNA, 689 bp, Homo sapiens
  ENST00000498287
agccggtgaagcgggaggggcgggatcacagcgagcgctccaatggccctcgaggctggccacggtggactccggcagccaatgagcagcaggcggggaggcgtggcggggcgctgttgcaaagcatccaacgtgggccagcaggcggccgcggagcgcggagcctaggggaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaaca

SEQ ID NO: 11638 - DNA, 504 bp, Homo sapiens
  ENST00000475366
acatttgatgatcgagaaataccaaagtgggtattttgagcatcagtagactttagtatactgattatggtgttgactgattcgattttaagatatgagcagcatgatttctgaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagctt

SEQ ID NO: 11639 - DNA, 409 bp, Homo sapiens
  ENST00000495671
ctgagtgatttttttcatttgattatttgcagaatatgttcttttgccatagggaatatgtggctgcttagcttactgaagagaggtagcagcaagtacagaaccttctcctgagtggagatccttggataggatactagaggaatgattccagttcaagatacaattttgtcatcttaatataagcctttaatgtgcattatccgcttgttcagttgtggtttttggttaacaaggggaagcatcacaatacaaaaaaagaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctg

SEQ ID NO: 11640 - DNA, 5273 bp, Homo sapiens; identical to SEQ ID NO: 11631
  ENST00000631853

SEQ ID NO: 11641 - DNA, 5283 bp, Homo sapiens; identical to SEQ ID NO: 11632
  ENST00000633161

SEQ ID NO: 11642 - DNA, 4129 bp, Homo sapiens; identical to SEQ ID NO: 11633
  ENST00000632666

SEQ ID NO: 11643 - DNA, 2336 bp, Homo sapiens; identical to SEQ ID NO: 11634
  ENST00000632591

SEQ ID NO: 11644 - DNA, 580 bp, Homo sapiens; identical to SEQ ID NO: 11635
  ENST00000631562

SEQ ID NO: 11645 - DNA, 598 bp, Homo sapiens; identical to SEQ ID NO: 11636
  ENST00000631537

SEQ ID NO: 11646 - DNA, 689 bp, Homo sapiens; identical to SEQ ID NO: 11637
  ENST00000633144

SEQ ID NO: 11647 - DNA, 504 bp, Homo sapiens; identical to SEQ ID NO: 11638
  ENST00000631476

SEQ ID NO: 11648 - DNA, 409 bp, Homo sapiens; identical to SEQ ID NO: 11639
  ENST00000631776

SEQ ID NO: 11649 - DNA, 1693 bp, Homo sapiens
  ENST00000553277
ggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaata

SEQ ID NO: 11650 - DNA, 14897 bp, Homo sapiens
  ENST00000243077
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaa

SEQ ID NO: 11651 - DNA, 2169 bp, Homo sapiens
  ENST00000338962
gcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcacctgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtggctctagccaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaata

SEQ ID NO: 11652 - DNA, 2175 bp, Homo sapiens
  ENST00000554174
ggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggt

SEQ ID NO: 11653 - DNA, 1847 bp, Homo sapiens
  ENST00000556830
ttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaaccaggagtgattttggagaaagtgctggtgagccaggagctaaaaacccttacagatgacagggtgcagcctgggagccttccagaagtagaggttggtacagaagcatgatgtaaggggaagaacagtccagggaacagcagtgaggagcaaggaggacacataccagcctccaggtccatggtccatgggatacgggaggggaaatcgccacccatggggccatgggaagtttcagagattagagaggggtgggagatgagtcagaccaggcaagcgcccagctgtgaggtctggagaccgggctcacacaggagcctgcacttgtggaggttaccaaggcacagacaaaggacgtcgtgatttagctgctaatgggccaagacagatagtgatggtgaggcatacgttctggggacaggatgggtggagcctgcgcggatgtggtgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaattttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaa

SEQ ID NO: 11654 - DNA, 292 bp, Homo sapiens
  ENST00000553446
ctatcccacctgcttccccctgactcagtttacctgcaacaatggcagatgtatcaacatcaactggagatgcgacaatgagaaggattgtggggacggctctgacgaacagacctgtcctgagcctgccgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcacc

SEQ ID NO: 11655 - DNA, 418 bp, Homo sapiens
  ENST00000554118
cccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgaactctctccatgccgaatcaacaacggtggctgccaggacctgtgtctgctcactcaccagggccatgtcaactgctcatgccgagggggccgaatcctccaggatgacctcacctgccga

SEQ ID NO: 11656 - DNA, 499 bp, Homo sapiens
  ENST00000555941
tcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgcc

SEQ ID NO: 11657 - DNA, 550 bp, Homo sapiens
  ENST00000555124
aatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctggatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacg

SEQ ID NO: 11658 - DNA, 611 bp, Homo sapiens
  ENST00000556247
cccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgcccct

SEQ ID NO: 11659 - DNA, 1284 bp, Homo sapiens
  ENST00000451724
tggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagac

SEQ ID NO: 11660 - DNA, 5114 bp, Homo sapiens
  ENST00000556356
tcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 11661 - DNA, 16535 bp, Homo sapiens
  ENST00000389484
aaagacagaaccccagagaaaaacgctgccaattcgttgctttattgttccctgcctggggacctcaatagccttttccattaaccttcccttcttacgcaacggttaatgactttgggggttgttttgctttctgtttctgctgagtcactaaattttgcctctttgtccccaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagttagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcagggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcaaaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggatatcgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgcgacaataaggatgactgtggcgatggttcagatgagagaaactgccatataaatgaatgtttgagtaagaaagtcagtggatgttctcaagactgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcatattatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataatatataagcacacaaattggtgacagaatttcaattacgtgaacgcatcctctttgctaggtcaaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatatttaa

SEQ ID NO: 11662 - DNA, 3810 bp, Homo sapiens
  ENST00000437977
gtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaagccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcatattatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataatatataagcacacaaattggtgacagaatttcaattacgtgaacgcatcctctttgctaggtcaaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgtt

SEQ ID NO: 11663 - DNA, 839 bp, Homo sapiens
  ENST00000442974
ggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctctgtggggtttaaaagtcagcgctgtgaccagaaagagaacccttgtgatcactactgtcagaatgaggggatttgcactttaactgcgtttaatgagccgagatgcaaatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtctttta

SEQ ID NO: 11664 - DNA, 2621 bp, Homo sapiens
  ENST00000434794
gcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacgg

SEQ ID NO: 11665 - DNA, 514 bp, Homo sapiens
  ENST00000486364
atcagcagttgtgtgatcctggtgaatttctttgccacgatcacgtgacttgtgtctcccagagctggctgtgtgatggggaccctgactgccctgatgattcagacgagtctttagataccttttgttttgaaaacctttaaaagggaggaagaaaacaaaatctctcagcttacagtctgtacggtaataggccacaggtcagatttggccagcaggctatataatttgccaaatctttgttgtagtagcgtagctgaaatatatctgctatacagttgaggcaggtctgtgctcaggcactgctgctccatggaacagcataacctcacacaatgaatgcacgaagcacagagttttgtttgcatctaccagtcatggtgccagactgatgcaatatggtgtagtctacatatgctgggttttgtttccttctattttttcatacttccttattggttaggattgcatttgactgcatgttatagaaacagtgacttaactgaataggggt

SEQ ID NO: 11666 - DNA, 15808 bp, Homo sapiens
  ENST00000263816
aaagtgcagggggcgggccgggcggcagggggcctgcccgctggattcccgcatgcttgttccggggcggtcgggtctaaagggctttatgcactgtctggagggtggggactggcgcgggtagaaaacgggatgcctcgggcgtgggggcaggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaatggatggatggatggatggatgaatgaatgaaacatatactactgattattttattccagagttctcaaaatatttgttgctgatattttgagtgctgactgtaattactttgattagataaacaactggaaataatgctgctgaaaaagttctaataaatgtgtattttatcaga

SEQ ID NO: 11667 - DNA, 556 bp, Homo sapiens
  ENST00000491228
agtagaagcctaagaacataacagctagtgaatgatttgctttttcctttcaggtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaa

SEQ ID NO: 11668 - DNA, 557 bp, Homo sapiens
  ENST00000461418
tttgcctgaagaaaggtgacttctaacaactgtctgtgattctcagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccattt

SEQ ID NO: 11669 - DNA, 4007 bp, Homo sapiens
  ENST00000443831
aggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgtgtttttacttctttttatgtctttgttt

SEQ ID NO: 11670 - DNA, 567 bp, Homo sapiens
  ENST00000493501
atttgtgacaagaaattatttagcttttcaggcatttaattgaactaactacagctttaattataataaagcaaaactaacaaattgtatgatatatatgtgtcttttataacaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctt

SEQ ID NO: 11671 - DNA, 7819 bp, Homo sapiens
  ENST00000500728
gctggagtccgccggcggcctcgccgctgccggccgctcacggaggaactacaattcccaggagaccgcgcggtgggtgggggcggggtagtgggcggggcatcggcaggctaggttttctccgcgcagcgccagtcgcagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcttgaagggatcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtggacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtctgagcctggaagaggctcgggtctggctccaggcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctctgggcgtggttcccttcccgtgtctgagcctggaagaggctcgggtccggctctgggcgtggttcccgtgtctgagcctggaagaggctcgggtccgggtccagctccgagcgtggttcccgtgtttgaacctggaagaggctccaccaggcgtattgtgttttgactgcagctggatcttggcttgactgttgagatctgccaaacatccgctaagctatcatttctgagaaaggtcaaggctagaggcagcatgtcgggagttggcgcatcagggttggaagggccccagggtacagcatgtgggtgcctgttcctttgtggacttgtgtgtgtgtggctggtggggcggggggtggattctggttcttttttttcccattatcctgagagccttaaggtactcagtgtgttggtgagactcagccctgtcatctagcagaagtgtgttccttttcattgctgtatagtattccattgcatgactgtcctgtgctctgattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaaacccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggtgaggtgagccggcgctcgctaatcttattcccagtctcggtgaacatgggctcagtctctcccggctcagtgttgggtttgcactggtgcacttacaggcagaagagcttcctcatttgctgagggcttttcctgaatccgtgttgaatgtggtcagctgcctttcctgcacctagtgagatgctcatgaggtcacttccttaccgcattactgtagtgaattacgctgactttcatatgccaagatgacctggcatttccaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtctgtcatggtttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacgaggtactaggacccaaagcaaatgtcagtaattcgcagatgataatgtataaatatatgatatgtaggtaaataatacaaatcacattctttggccagagtgcaattgaggaggaaatcagtaacaaaaagacaattaaatccatttgattcttttgttttcgttttgtagtaacttgcacttccctggtgccagaggcatgacacctttttgtctgctcttggccatttgggtggcgtctttgggaagggcctacttaattcttttgcctatttaaaaaactgggtcttggaaatcttgtctttttttttgagtcaggatctttctcgcacaggcttggagtgcagtggtgcgatcatagctcactgcaacctcaaactcctgggctcaagcgagcctcccacctcggtcttctgagtagctgggactacaggcatgcatcactatgctctgctaatttaaagaaaaggttttttttatagagactgggtctcgctgtgttgcccaggctggtctcggagtcctggtctcaagtgattcacctgcctccacctcgcggagtgccaggattacaggtggcgggagccgccacacccagcctggtcttagcgttattcccaggtctaggtgtgagtccttcctcagatatgtgttgtgaataatttccgatcctctggcttgctattttactttcttaatggttatcttttggaaagcaaaggtttccagtttgatgaaatctaatttttattttttatttttccgttctagtggtctttctattttctcatcaaattgagactttggggaaactacacagcagcaaaccaggatatatcctcttaaaaacagctcgagccggccgggtgcggtggctcatgcctggaatcccagcactttgggaggtggaggtgggcggatcacgtgaggtcaggagtttgagaccagcctggccaacatggtgaaaccccatctctactaaaaataaaaaattagccaggcatggtggcaggcacctgtaatcccagctacttgggaggctgaggcaggagaatggcttgaacctgggaggcagaggttgcagtgagccgagatcgcgccattgcactccggcctggggacaagagcaagacttcgcctcaaaaaaaaaaaaaaa

SEQ ID NO: 11672 - DNA, 1078 bp, Homo sapiens
  ENST00000296325
gttggagcggggcccaggggtcggaggcggaggggggcgcagccggggcacctgtgccctacgcgccctgtccttggcacagcctcccccaagtgtcaggtggggcgccccgaccccttctgcagcaggaaaggtacccgtgccggcgacgacgccgtgtgaagcagctgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgt

SEQ ID NO: 11673 - DNA, 1167 bp, Homo sapiens
  ENST00000515119
gaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgaaacctcccggtggccagcctcctccgaggtcagtttctcgctgtgtcctggtccgtcctgctcgtggctcacaggctcctccccttcgttcgcagctgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggtaaggaaacacggccctctccttctagctctctcctgtggtgaagattctcttgcagtttccgggtaaggaaatgcagccctctcctccaagctctctctctcaagattctcgcagtttcttccttaaccactcggtgaacctgcttgcgttttccttctcatctgcgtgggaactcgtgtttcaggggcggggccaggctctggagggaggggctttggttcttttgtccgt

SEQ ID NO: 11674 - DNA, 1170 bp, Homo sapiens
  ENST00000509198
gcagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatggaaaccatatcaaatagaacctcccctctctcctagtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctggtgagtgcccgcccgggactgttggttcccgagggtggggccgtctctggttgtgttttggggacaagcaggcaggtgcttgtagcgacgggaacctgggcctgtggacgcagcggagaccctcggcgcgctcagtctacccacgggtggtcacaggcctcgctcccaggagctgctccgtgaaggtcactcgccgtccccagccttgtacctggagactagcagagggcagtggcggcagcgggcctgggagcagcccttcccagcgtctccccagcctcagcagcacggcccctcccgtgctgctgttggccaagaacagagaccactcgtcaaacatagctccgtctccatctcatgccacccacaccgt

SEQ ID NO: 11675 - DNA, 2527 bp, Homo sapiens
  ENST00000487251
acttctggggcagccgtgagcagcgggcacacgggcagccacgaaagcagcagcgagggtggtgcaaacacctcaaaactacaccgaatccagtagcgcctggcgcccccggcgcgcaaggccgcctctactccgcctcatctttgtcccaagtcctttcacagtctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagaggtatgtgcttttagagaaatcacatgataataattatgaagaaataataataatacataagggatcaaaaatgtcaaatgctttgaaaagacgcatgtgttgttttttaaaggtgtgaactctaaatctgtgagtatagagccaactggaggaattatgtcaaagaatgatcatcagtaacattaaggagagttggaaaaggtgaatttataggattttaaatgggagaaagaaagagattgacattttgggtttgatatacagagaatggtgacaccattggcagaaattgataatttgggagtttgacagaggaagtggatgcctttgggtttgatttttgaatttaatgtgaaattaagctccatcccataagcaattggaattataaaaattgatcttgatgcaaccatatttctgggcagagatttacattgggccatgctcatgtcttggatgaggttgaacaaactgttcacaaaggcatacacatagaggaaggtgaatgggaagctaaagccagcttcctaggactttttttttggttagtagtctaagcacgagaaaatgagacatcaccatctgttgtggagagtagctgtatggactgagaggcatttaaattctggcaagggaggtggaaatgctgacaatgaggaggaagcttatagtgggtcaaacaaggaggtgtctagtgtgttgtttaaaaagaaggcttacaattagccaggcgtggtggcgggcgcctgtagtcccagctactcgggaggctgaggcaagagaattgcctgaacccgggaggctaaggttgcagtgagccgagaccacgccactgcactccagcccgggtgacagagcgagactctatctcaaaaaaaaaaaaaaaaaaaaaatgaaaag

SEQ ID NO: 11676 - DNA, 3180 bp, Homo sapiens
  ENST00000370888
ggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcagttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggc

SEQ ID NO: 11677 - DNA, 808 bp, Homo sapiens
  ENST00000370882
ccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaagcagaagacaactagctgacacctgttcagccagcaagttggtgtttttctgaaatgtacactgatgttttatctttatgccattagacttgctaattaaaaattctgcccttaaactctcaggaggagaagaagacaggaagccctcaatacactctaggtgtatggtatcagttgcagagaaaacagtggtat

SEQ ID NO: 11678 - DNA, 555 bp, Homo sapiens
  ENST00000490222
ttttttttttttttttgctctgtaatctggaggttctaatgggagaagtgagagcagaaaagggaagcacaggaacctactgaggaatccacttgcaaagagtatgttgcgtcttaaaaacataacaccgtttttacattttgaaaccaatctcaggaagctccttttaatttttcctcattttgttgatagggattgatttgattacaaaatttgaggttgtgatgtctctttttttaaaaaaaaaaaaaaaaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaaga

SEQ ID NO: 11679 - DNA, 5100 bp, Homo sapiens
  ENST00000395905
cattccacaccctccgggatctccagtgtgaaaatgtctggccctgggtaggaggctgcagatagtccctgggccggggctcgcgctggccggctgcagcgcgcagggtgccaagccctcccctacgaagtctgttttgtctcaggctgggctgagtcacatagaatagatagatagttgatttagcacatgtcctccagatcatattatccgcctacaaatatagcctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaaaaaaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttatttacatggcagaatacatgtatgaatattaaagt

SEQ ID NO: 11680 - DNA, 1963 bp, Homo sapiens
  ENST00000296144
acttcaaagggcaaaagaaagaggagaacctccgcttaccacagccgggtagaaatgcctgaggaaagcagcggagctgaccgtgccagcatttacacagggaacacttcttgggcagccaggtgtcatggggcacagacccacagttcctgagaatgaacaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataa

SEQ ID NO: 11681 - DNA, 451 bp, Homo sapiens
  ENST00000496388
tgtgaaaatgtctggccctgggtaggaggctgcagatagtccctgggccggggctcgcgctggccggctgcagcgcgcagggtgccaagccctcccctacgaagtctgttttgtctcaggctgggctgagtcacatagaatagatagatagttgatttagcacatgtcctccagatcatattatccgcctacaaatatagcctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggataaaggaggagtggaactttgtggccgaatgcaggaggaagggcatcccccaggctgtatactgcaagaatggcttcatagacaccagcgtgcggcttctg

SEQ ID NO: 11682 - DNA, 561 bp, Homo sapiens
  ENST00000469912
cggtgtaaacagccgcggcgggcaggccaggactgtcagtgcccgcccctcggggcaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagtacgtgttttctcaacctagtcttgtagcttgtttggtgaataaggatttggacaggcaacagttgcgttgtggaggaggatgcttttcttctgggatttctcactgttggtaaaattttcctcattaaacttcagagccttacactgttgctcagtacaaatacgcagttcctatgatagcaacacccatggttataaggacctacccaccacccttgtggtaggcacgaggaagaccgagatgacacgataaatccccccacagtaaatgctgtagcaggctgcctagctagagttcactgagctaactcactaggctgtctggcgctctggacaccatctgactgccatctgggg

SEQ ID NO: 11683 - DNA, 3414 bp, Homo sapiens
  ENST00000355790
ggaggctcagtccgaggatgcctagatgttagcgagggagcacgcgctgagcttcccgaaccccatgccacaaaaacaaggcgccagcaggtcccgctcacgtcccagcgggcttctttccctggggtggggaagtgggtcaacttcgttctgatctgaaggggggtttgggactatttgggtcgctcctcacctccccacccgctccccggcttggcatggtccagagcccgggctggagccagcggtagggccagcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 11684 - DNA, 3095 bp, Homo sapiens
  ENST00000373224
gcgtgactgcgctgcgcagggcgctaggaggcattgtcgccgtaagtggagccaaaagcggcccggagcgggaccacacgcttcttgccccgcaaagctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 11685 - DNA, 2924 bp, Homo sapiens
  ENST00000358141
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 11686 - DNA, 2906 bp, Homo sapiens
  ENST00000357631
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 11687 - DNA, 663 bp, Homo sapiens
  ENST00000446961
ggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtc

SEQ ID NO: 11688 - DNA, 2903 bp, Homo sapiens
  ENST00000395011
gtgcaaaggccaagctggatgtggcctgagctctcggccctgcaagaggaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 11689 - DNA, 2959 bp, Homo sapiens
  ENST00000395010
ccccgcgcgccccgccccgccggctcggaactcgcctggggcgccgccggcggcggagggagcgtgactgcgctgcgcagggcgctaggaggcattgtcgccacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 11690 - DNA, 2209 bp, Homo sapiens
  ENST00000376085
ggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttcctgtccgggtaaaccctttggtgagtccctcgcccctccctccccgcccctcccctctccatccctgctgtcccggctccccagtccgtccgcgccgcgctccatcgcccccgcacgcccgggcgcacgccctccccgcccgggccgccctctggctccccgcgcccggcagccagtgcctcaccgcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaaggccttgatgaaatccagtgctccctgcccatggagagcaggaggatatccctgcgtgagctgtcggaggccagcttcagcgagtgtaggttcagcctgtcactcacagacctctgcatcatcattttctccggtgtggccgtgtccattgcggccatcatctccagcttcttcctggccactgtggtgcagtgcctccagaggtgcgcacccaacaaagatgcggaggatgaagacgaggacaaggatgactgagccacctcctccctcctgcctcttactctccagcaccgaaccagaagctctctccaagacgagagggaaatgctgaaaatggaaaagcactggccaccatctgtgaactgaacagagcctgttccgtgtcttggcccctgggtacacctgctgggaccactgatctcagagtttagaatcagcagagcacagaagcccaggaaggatggagggaattattcctggagcataacctgcctctcagatcgaggtgtgtgttgggggagaagatgaccgagtcaggcttcatagctgatgactaaaagcctcccccaggaaatgtgaagactggcagctttcaatggcaaagatgattttacgccattctttttctgacctgtactgggagatcatgaaacatctgccttcctcccaagaaacagcagctcaaacagtggagattcaaattcggatcattcaccacaagaacgagaactttgatccttatataataggcctcagcaaccttgggatgttatactgggaactaataaactcgtgtgcaatagactcaatgtttatgttcccccagattttatatgttgaaacctaatccccaatgtgatggtatttggaggtggggcttttgggaggtgattaggtttagatcatatcatgaggatggggcccaaatgatgggattagtgccctcatgaaaggtggccccagagagctccttcaccccttcaatgcttgaggatgcagcaagaaatcagctgcccatgaaccgagaagcaggccctcaccagaacccagccatgctggcacccagatctcagacttccagcctccagaactgggagaaataaataaatgtctgttgtttgtaa

SEQ ID NO: 11691 - DNA, 1696 bp, Homo sapiens
  ENST00000396641
attgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 11692 - DNA, 489 bp, Homo sapiens
  ENST00000414619
gaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatct

SEQ ID NO: 11693 - DNA, 927 bp, Homo sapiens
  ENST00000432040
gggtacctgggggcgcgtggagacaaggaatggagccccggaatgccgggcccttgggtacttgggaaggcaggctgctgagtgcctgggatggggcgatcttcctccccagaagcaaacaaacctccccgcgagaatctgaatgcgttggcatcttgggtggtgactgaatggtcagatcgtggactagggatgcttctccaagctctaagaggaccatagtctgctctcttctctggcacccgcttgcttctacgctccttcacctctgcagccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaat

SEQ ID NO: 11694 - DNA, 1695 bp, Homo sapiens
  ENST00000417744
ggaaacgcagagctaggaggtgtgggcctcgggtgaggggagacccagctcttagacctgggagcccagacagaggtggatctgcccaccttgcagctcccagaggactcctgctgccttgtaccagttgggaaaaagcaaaattcagagcagttcctttttctgggtccctcgccttggccacatcggaggaaacgtcgactcgccagggctcccgggagaaatcccgaggtcagtccctcccattctggggcacccctggagcagctagctccctgcctagcggtggcaaactccagagccccaaggagcagaacggggattccctgtgcgcaggctcctggtgcagctcctgagcacaaaggccacaccctcacagaccaggcctggtgagagagccgggcttcttcagaagtacctggatacctgaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 11695 - DNA, 905 bp, Homo sapiens
  ENST00000469437
gctaggaggtgtgggcctcgggtgaggggagacccagctcttagacctgggagcccagacagaggtggatctgcccaccttgcagctcccaggtagattcttcttgtggctccagatgctctggcgaatgcaggagggggaggctcttttctcctttgcaccccagcaatctggagtgcaagaccgtttgcgggagggggcttagtcggctgtttcgaagaggcagcctcccctcccttttatccatcaagccccctatttcctggtgggggcacagtgactgccaaggccagtaagcacctcacttaacccttctctccctgaggaggtgcatgctcctctcccagaggtgcctttggctgagagtggatccctggttcctagtagccctatagggaaacatttggaggttgggtgggtttggaaccctgtacaacctttaggtcctccctgttcagaccttccacgtgcaggcttttcttactttctccgcgggtgccctacagaggactcctgctgccttgtaccagttgggaaaaagcaaaattcagagcagttcctttttctgggtccctcgccttggccacatcggaggaaacgtcgactcgccagggctcccgggagaaatcccgaggtcagtccctcccattctggggcacccctggagcagctagctccctgcctagcggtggcaaactccagagccccaaggagcagaacggggattccctgtgcgcaggctcctggtgcagctcctgagcacaaaggccacaccctcacagaccaggcctggtgagagagccgggcttcttcagaagtacctggatacctgaggtgcccaagcaaggaaagaaataatgaagagacacatgtgttagctgcagccttttgaaacacgcaagaag

SEQ ID NO: 11696 - DNA, 1551 bp, Homo sapiens
  ENST00000456208
atcagaaccacatcggaaatcaatgaaataagcattattcttagttctagttgaggaaactgacatgcggaacaattagttggcctgtccaagacctcctagctggtatcagaaatgaaagttgaacttgattttatctagcttcaggttctggatgatttctgtacattttgttgagaccaagaaagtttaaacggtccagggtggctccactggctcaaagggaaagaggatttagtaagtggcttgatttctcttctctgccttccattccactccacccccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 11697 - DNA, 4054 bp, Homo sapiens
  ENST00000278198
aagaaagaggggcagaggagggaaggcgactgcagtccgaaaggagcttttggaagctaggaccctaagcgtcaggacgtggcattggtcgagagaaagcctgggctggcaagagctgccgccggtgctgggagagcatttatttgggagaaaaagaggggagagagcagagggagggggaggaagagagttcaaaccgaagtggatggaaggggactggggtttctgccgcgcagggagccgtgagccagggcgatggcgctaagggcggcgcggagcagctgcgctcccgagaacgcgtctcctcgcagaggactagcagacatcgggaaggtctgcgccaacgggaaccaacttgtggctccaaaatgtacccaacgcagctggaaatgagatcaaagctgcagttgcatttgagaaggatgagaagagccagcgattagggaattttttttttacccgttttcttcctttttctttttttcttctttttctttttttctttcttttttcgtgtgtgttttttttaatttgcctaccaccctgtctgtcccctcacttcgccctccccatttgaaataaaagccccagtctcaacttccatcacctcggcgctcccggagccactaccggctgatggaggagaaggggacccgggggctggcaggggccaccggcgagggaccgcatcctgcgtctcccccgtgatcccggccccgaccgcggagttctgcaacacctggaggatctggaccgggtgctgggggtgggggcggggacagaggaaggaaaggcaccccgagccttaaaaagaaaaaaaaaaagtagcggggggaggaatgggtttcttcttgacagctgacggagccttgaaattttcctccactacctccgcccccgcccccgcccccgccccccgcactccatttaacgtgagattatgaaattgcagaggcggtggagggaaggagacaggatataaccggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctcctttttttttaatttttattccttttggtatcaagatcatgcgttttctcttgttcttaaccacctggatttccatctggatgttgctgtgatcagtctgaaatacaactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcagac

SEQ ID NO: 11698 - DNA, 3085 bp, Homo sapiens
  ENST00000527150
ggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctcctttttttttaatttttattccttttggtatcaagatcatgcgttttctcttgttcttaaccacctggatttccatctggatgttgctgtgatcagtctgaaatacaattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaa

SEQ ID NO: 11699 - DNA, 2650 bp, Homo sapiens
  ENST00000528697
ctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaagaaatggttctctttactgcgaggctgcaaggtcacccaatgagagaggggccaaataagctggaacatcatctaatacactgaatgtaggagttactggaaaagcaagaataacttatgcggattaacaatatggaaacatcctgagactactttggaatcgccataaattaagtgggttccagttttgcaaacagagaaacgggtccatgaacaatttgctacaggtataaagaagtatctgcagaaatccagagcacttattaaacttctttgagttttctcaggaagatcaatacctgttggagaaattttactaagagcaagaaactgagagtgagaaagaagggactggccagagttactcagctagacagtgacagacaacagtggaacttctgattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggcta

SEQ ID NO: 11700 - DNA, 2669 bp, Homo sapiens
  ENST00000530763
ggtatttcgtacagtaggagatttcaacaacgtgacaatattctctaggcacttgggctcactgtctgtagcccccaccccccgcctttcgccacctccttgcttccctactcccccttctgcttttgcctttgatgagtttttggcttactttttggcggagtctcttggacacgtttttgctggtgctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaaggagttactggaaaagcaagaataacttatgcggattaacaatatggaaacatcctgagactactttggaatcgccataaattaagtgggttccagttttgcaaacagagaaacgggtccatgaacaatttgctacaggtataaagaagtatctgcagaaatccagagcacttattaaacttctttgagttttctcaggaagatcaatacctgttggagaaattttactaagattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggcta

SEQ ID NO: 11701 - DNA, 583 bp, Homo sapiens
  ENST00000533474
acttctcaggcaaagagcatgccaacagcctttctcttctgctttgcttgtctgtggtggatactagcaacctatgtggttctaaagtatcaagctgagattatagtatcaatgagttggaacatcaatagtgccaagtgccatttaaaaatcttttcatcttcttgtgtgttgcttttggagaggaaatgttttcagatgtggtttctagccttgcagaaaaatggcattttcaggctgtatgggactcttacatcatctagtttcaatcacctcattttgcagagcaagaaactgagagtgagaaagaagggactggccagagttactcagctagacagtgacagacaacagtggaacttctgattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctg

SEQ ID NO: 11702 - DNA, 562 bp, Homo sapiens
  ENST00000534577
agtttttggcttactttttggcggagtctcttggacacgtttttgctggtgctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaagaaaccaaatgaagtgtttactgtcattatccgtatttgatgaagaggatactgaggctcaaagagaattaataatttgttcaagaccgtctaatgtggagtaatcaagagtgaatgccctgaaagtacacaccccagcctggaccagcattcttttttttttttttttttttttttttgagaggaaaaactacagagacagagtagcagcagaaatggttctctttactgcgaggctgcaaggtcacccaatgagagaggggccaaataagctggaacatcatctaatacactgaatgtaggagttactggaaaagcaagaataacttatgcggattaacaatatggaaacatcct

SEQ ID NO: 11703 - DNA, 2286 bp, Homo sapiens
  ENST00000619527
ttcctgcaggtataaagaagtatctgcagaaatccagagcacttattaaacttctttgagttttctcaggaagatcaatacctgttggagaaattttactaagattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcag

SEQ ID NO: 11704 - DNA, 571 bp, Homo sapiens
  ENST00000518304
tcagatttaatttttggacaggaacatttcataggtggtgctgctgtgtactttttaattcattacttcataaggcttataatgtgattgtctcaattttattgatgctaaaatgattagtgggttattaacctgatcacttgattataaagttcctcatcaacctttcatctaatactttcagtctccaattatgatttttgcatagctccattattttattagaatttgcaaaaattgtgattattctagttattttgtctttctcatttattagtttcaattcttgtgaataagaactttattaactattaagttatatttaagtgcagtttgtactggaaaagcagaataaatgcttatattttttcctttatcaattttcagactgagttggtgcgctagtaattcccaggatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaa

SEQ ID NO: 11705 - DNA, 1861 bp, Homo sapiens
  ENST00000520099
gaactctaatggttaccttgttttctacttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccaggccgggtgcggtggctcatgcctgtaatcccagcactttgggaggctgaggcaggcggatcacttgaaaccaggagttcgagaccagcctggccaacatggcaaaaatcccatctctactaaaaatgcaaaaaaaaaaaaaaaaaaaaaaaaaaaaaaaaaaaaaaaaaaagccaggcgtggtggcacatacctactacttgggaagctgaatgagaatcacttcaacccaggaggcagaggttgcagtgagccgagatcatgccaatgcacgccagcctgggtgacagagtgagactgtctcaaaaggaaaaaaaaattcttctaattatggcttacaaaatttaatcctgcttaatctgaacaacaatcatcttacgcagcttcctcaagaagtcagcagagtctggccctactcacccaggctggagtgcaatggcatgatctcggctcactgcaacctccgccttccaggttcaaatgattctcctgcctcagcctcccgagtagctggtattacaggagtaaaacagaaatttatttctcatagttctggaagttgggaagtgaagaccaaggtgctggcagatgtgatgtctgattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggaactttgtgatcttaaaaaactaagaatcctagacatagctggaaatattattcagatatttccatcaggatttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaagaaactacaacctaatacaagcaacaacagccagaatttatttggtactgagtgtgcatctggtgctctgctaaatatgtcacctggaatacctcaattaatgtccaaaataaccccatgacaccagtaagaaatccaaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaataattccattataacgttcccaatctaagcactacaatctgccttcagcttgcttagattctaggtgtgctttttttggcttaaaaaagtacaaaaaaaaattgaaaaat

SEQ ID NO: 11706 - DNA, 720 bp, Homo sapiens
  ENST00000343709
acttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccagtttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaat

SEQ ID NO: 11707 - DNA, 1044 bp, Homo sapiens
  ENST00000448384
atgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccagttgacaacactaaatctgggaaacaaccttttagaagaagttccggaagagatgaaatatcttacatctctgaagaatctccatttatctggaaataggatctgtagatttgcacctggagcctgtgatggcttacaaaatttaatcctgcttaatctgaacaacaatcatcttacgcagcttcctcaagaagtcagcagattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggaactttgtgatcttaaaaaactaagaatcctagacatagctggaaatattattcagatatttccatcaggatttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggactggaagataagcaagaatctgaagctggtgcctctccaagtattaatttgttcttacaaatgttttactcaacgtgaccctaacctctttggaattgctcaggtgtag

SEQ ID NO: 11708 - DNA, 415 bp, Homo sapiens
  ENST00000522144
tttgaatgggaagaagatgacaaagatgccctcagcattaggaaaactgcctggcctgaagactctagtccttcagaataacctaatccccaaagtgtgtccagagttatgcaacttgacccagttgacaacactaaatctgggaaacaaccttttagaagaagttccggaagagatgaaatatcttacatctctgaagaatctccatttatctggaaataggatctgtagatttgcacctggagcctgtggtaatttaatcaacaaggaacaacattatagcatcaaatttaatctctcatatttaataatatgagactgaaatgaaaaagaattttgcatgtttaatctttttttgttggagatatttacatactactcttgaaatataggaggagacaacacttttaaaaaa

SEQ ID NO: 11709 - DNA, 397 bp, Homo sapiens
  ENST00000518487
aacctccgccttccaggttcaaatgattctcctgcctcagcctcccgagtagctggtattacaggagtaaaacagaaatttatttctcatagttctggaagttgggaagtgaagaccaaggtgctggcagatgtgatgtctgattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggtaagcaaaacatggaaccacagtagtttgctgttggagaagaactcaacatgatggga

SEQ ID NO: 11710 - DNA, 488 bp, Homo sapiens
  ENST00000521519
ttaaaaaactaagaatcctagacatagctggaaatattattcagatatttccatcaggaaaatggccagatatggtggctcacggctgcaatcccagcatttcgggaggctgtggcgggaggattgcttttgattccatgagttcaagatcagcctggacaacatggtgaaacccctatctctacaaaacaaacaaaccaccaaaaaaattagctgggtttagtggtacaccctgtggtcccagttacttgaggtgaaagtatcactcaagcctgggaggtagaggttgcagtaagctgagatcatactccagcctgggcaacacagtgagaccctgtcttgaaaaaaaaaaaaagaaatatcttggttcttttatgaacatgtagtcagatctgctacagagagactttagtttctttccttacctcttttttcctttcttttattttaacttaaaaaaataaaacttaaaaattttgtaagttgta

SEQ ID NO: 11711 - DNA, 6507 bp, Homo sapiens
  ENST00000310961
gcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaacctaataaggggaaggaatcccccgcaataccagagaagtccttgtaaagaggttcgtgcagcacttcggaagaggcctgaagaggagtgagcccgctacatgaaaaaaaatgcaagtcaaagtggtcacaacctagaagtctgcagagacaggaataactagcaatgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatattgaatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcacttattagaa

SEQ ID NO: 11712 - DNA, 2375 bp, Homo sapiens
  ENST00000370958
gtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaacctaataaggggaaggaatcccccgcaataccagagaagtccttgtaaagaggttcgtgcagcacttcggaagaggcctgaagaggagttgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaacatctgaagatccagagtgtgccccttgcccaatcgcctgagactatacagtgacacctacaacagaggatgtggagggagcagcttttcgggcaccagaaatggcagcatcaggagcatcagcacgaatagactttgtagaggtagttctcccaaactatattatgaaaccaaacatttttggtgcgctacctgctgatgggggctgccttcttactgcctagtatctacaaaatgtttggtctttgttaaagtttaacgatgacatttctgactaatatagagagacctgatttttttccaaatgtgttcagttgccataactttcaatgaatatgaaattttatcagtctcagaaaaacattaatacccatatttttatctaattgatttcactatttgttatgttaaggtgcttttgtgtataatttttgtatatatttttaaatgggatcaaactaagccataatttaaaagtcatcctaatgcagtaaataagataatttctctagtttgttaaattcttcagagaccgaatataattgctcgtttttctgtcatactccctgatgatgttccattgtggacttattttgcaaagttcccagatggcacaagtcaaaatatgaaatgctgatgattgattgattttatgtatcctttcatcttatgtaatttaatgtggaacagttattttgtagctctaaaatacatttgttaattaaccatattggcttttcatgcagttcaatggcttatagcatttcaatttgcatagaaaatgaatctctgtaatgatacttttgctaaataaataacaatcgacataatgggttcatttgcttttaacattttatacatacaatttagaagtaggatatatttcatattgaaattttgaaaagcttgaaattcaacatacaaggtcaccatcttgctgatgcctaatgcagtacagcaaattcattcttcatcccatgttaactcctttttggaacaagtcaaaatacaaataatttacaatgattgtgttggagctattgcttgattaaatacaattcaaaggttctttttataaaacaggtgtgagcaggacacattgcacttacgggcttttcctatttttttggttctatttcattttactgcctaggaaagaaacatttttttgtaaaacctatgctatggaactgaaatgtactttattgaatatttctattctgttttatgaatatcaattatgtgaaatatataaatataaaattgccttagaatgcctaactctttgtataaaacagatatctgaaagtagatgttggttttttgttcaaattgtgtaaatgctgatttttccatgagtacttatgaagatctatatgtaaaaattttaagtctgcttactgtgtttgtaccaccttgttcttagctgtgtatactctatgctaattgacttctgtcattgtcacatatattgcatatgtctctcaaaaattaaaaggtatattgctattctaaaaataaaaaatgtaaattcctga

SEQ ID NO: 11713 - DNA, 5000 bp, Homo sapiens
  ENST00000035383
ttctgcgtttctctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaaaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaac

SEQ ID NO: 11714 - DNA, 775 bp, Homo sapiens
  ENST00000588515
agggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctttccactcagaggactcttatttggcttgaatgtggaaaaggcatctggttcaggcactgggacaactcttttccaaagaaagacccaaaaatcgtacaaataagtccaaatgaagcatgatgggaaatcagggactaattctgcttggaggacagggaaggctttcaaag

SEQ ID NO: 11715 - DNA, 712 bp, Homo sapiens
  ENST00000609498
aggcaaatggacacagttttgtacatatggaacatgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgtatctttcccattctgcctgagatcatagctatttggtgtttgtttttcctatgaactttaagctttttgagagagaggatcagacaatacttaacaaaggacttctagacagaagagcctcaggagagaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctttccactcagaggactcttatttggcttgaatgtggaaaaggcatctggttcag

SEQ ID NO: 11716 - DNA, 786 bp, Homo sapiens
  ENST00000608815
acagttttgtacatatggaacatgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgtatctttcccattctgcctgagatcatagctatttggtgtttgtttttcctatgaactttaagctttttgagagagaggatcagacaatacttaacaaaggacttctagacagaagagcctcaggagagaggagtaatcgttcagctcttcttggtttctgccttccctcctgctcttccagatgtcaaaagaagaatttacagtgaaaaataagaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctttccactcagaggactcttatttggcttgaatgtggaaaaggcatctggttcag

SEQ ID NO: 11717 - DNA, 792 bp, Homo sapiens
  ENST00000608744
atgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctgttggcagagaaagtatgactctgcttttagccttctgcacaagacaaaatccttctggtgatcctcagtctttccactcagaggactcttatttggcttgaatgtggaaaaggcatctggttcagaaaaaaagttgattacagttgatcctcattattcatgggtgctatatttgcaaacttgcctactcactaaagtttatacccccaaatcaatgtgtggcacttccgaggtcattcataaacaggcacagaggagcaaaaaattggagtcaccccacgggcatgttcccagg

SEQ ID NO: 11718 - DNA, 888 bp, Homo sapiens
  ENST00000609072
acatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgtatctttcccattctgcctgagatcatagctatttggtgtttgtttttcctatgaactttaagctttttgagagagaggatcagacaatacttaacaaaggacttctagacagaagagcctcaggagagaggagtaatcgttcagctcttcttggtttctgccttccctcctgctcttccagatgtcaaaagaagaatttacagtgaaaaataagaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctgttggcagagaaagtatgactctgcttttagccttctgcacaagacaaaatccttctggtgatcctcagtctttccactcagaggactcttatttggcttgaatgtggaaaaggcatctggttcagaaaaaaagttgattacagttgatcctcattattcatgggtgctatatttgcaaacttgcctactcactaaagtttatacccccaaatcaatgtgtggcacttccgaggtcattcataaacaggcacagaggagcaaaaaattggagtcaccccacgggcatgttcccagg

SEQ ID NO: 11719 - DNA, 476 bp, Homo sapiens
  ENST00000608470
aacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagccccctaggaccagctactggtaagtcattttgtccattttcattgatctggccacataaggaacatcctgtttctttaaatcctcaatgcttaaattgccatgtagaaatcaactccctatcaattttctacatttaatccttggcttcttgtcatattttcatttttctgcactggttcccatggcaacaagtctgttggcagagaaagtatgactctgcttttagccttctgcacaagacaaaatccttctggtgatcctcagtctttccactcagaggactcttatttggcttgaatgtggaaaaggcatctggttcag

SEQ ID NO: 11720 - DNA, 2556 bp, Homo sapiens
  ENST00000607936
ggtattgaaaaaaaagctctgtatctttgtatattcagttgtcaacatggagaagccaccttttaaaaaagatcagttctgtaaagcataatgcctactacacagacatcattattctacttaaaagtctttttttaaaattccaaatacttgtggtagtagaaagcaataaatattctaaaatgagggatattggtccttttgtgactgagctatatgataaactaaggaaaactacagaagttatgtctattaactctttaaggtacatgatatagcaaataatcatttgtacaacctcatagaaagttgagaggattaatcaaattgtttcaaaatttttaaggagccaaatttaaattctcaataccctatgagattttttaaactattttagattcttaccagaagaatgcatagatgtagtaaaaccattaaatacagtagtatctggtggcctttctgtgtggaggagctcgtttgtccaaggtatgatctaccagtgagaagatcagtgccaggtcacagaaaaagctaatcatttttagtttaatcctgaccagctagtcttcctccaggcatcagctacctgattttaaagagaccatattagaaatgaaaagcagcagtctctatcatatgttaaattcaaaggcatagctgctcgtgaagaccctattatgttttatttgcctatcggagaaagagatctgcctacctgcctttaggaaaaagcaatgctttatgtagcttcaattagtcctgcatcaggttattctaatgcttcctactgcaaaaaccaagcccacaagtctccaatcctaaaagtcactagaatattgatataaggaattctgtgtcagcagtatctcagtattcaaacctctgtttagggtcctgcatgtactatcaaacagcaagtgatagaacattcaggcgttttattggatttcagaattcagattcagaattaagtactcttgggataaaggaaattaacgagcttttgacatttcaagaactcattgagattgtcaaaggcttcagtaatgaactctaacaaatagatccagaagtcataagtgagaaagaaaacaagcatgtctagtgaaatctgtccagtgtacgtaacactgcacaaagagcatattttattcagaccatttggattcagatgtaccctaaagacaactatgctataatggcttgtctcctacttcctggcctctagccctacccattgcccaggtggacgttatgtttttagtttttcctttgtgggtgagggaagaagaggacatcaggtgaagtgtgccattactatttgaaaactagctctgcaggaagggttaaatcaaatcctttacagggtgaccttcctacatctccttagagcaactgcatttcaaaataggccaaagctgaagtcataggaatgagacattaattgtaggttttcaggaaagcttcggagacacggcaggtacagtctccttagagcctttgaaaatacaacatgtaggtccttctcagattatgctgaaactccaaatccttgttaaaggttttcctggactcctacagtctggtttgatcagtttattattaagtactgaatgacagagaagggtacacagggaggacttgtatcacatgaagtaaaataattatttccttaatgagaaacttaattctagggtacttacaatagctgccttattgggggaagggaggcatagatttgcaaatggtgggttttttcgtttttttgtgtgttggagtaattgaaaagatacatcaagcaataataaactagatgtgcaataatcttgtcgagtagtatgtgctggttttggaaaggtgaaaagaaaattgttacatcaggctgcttttatcaagctaagcatgggcatgcctttccaaagggtatatttgatcctacagttaattttaacattgggctgcaagcttaacctcatcaggagtggaattagattttacaaagttccccttatccaaactacagcacgcttactactttctccttccattttccacacctcagccccctaggaccagctactggtaagtcattttgtccattttcattgatctggccacataaggaacatcctgtttctttaaatcctcaatgcttaaattgccatgtagaaatcaactccctatcaattttctacatttaatccttggcttcttgtcatattttcatttttctgcactggttcccatggcaacaagtctgttggcagagaaagtatgactctgcttttagccttctgcacaagacaaaatccttctggtgatcctcagtctttccactcagaggactcttatttggcttgaatgtggaaaaggcatctggttcagaaaaaaagttgattacagttgatcctcattattcatgggtgctatatttgcgcactgggacaactcttttccaaagaaagacccaaaaatcgtacaaataagtccaaatgaagcatgatgggaaatcagggactaattctgcttggaggacagggaaggctttcaaag

SEQ ID NO: 11721 - DNA, 2983 bp, Homo sapiens
  ENST00000565615
tttctcttaataaaatgatatattttgttttgaactttggaattccattgtggcttggcactaaattataggcctagcaatcctaaatctcctatgtcctcaatatctagaaacaagcaggaactgtttgtcagaaattaaacaggacttatttgaatgtgctttaaaaaaaaaatcaatgaattcaggggaatgaaaatacatgttagaaattaaaatgtggttatctcagctatagttaagaaaattatcaaatgtaaatgatcccttttttgctggatcttataaaatatgtgatacttaagtacactgaagttttaaagttagctgcttatattgtacaaagatatttttggctctttaaaggttattttcctatattaagaaaaggtttcttatattgaaaacttttatggtgactcaggttttgtgtctatgtataggcacacataaataggaggtgtttttctttgcacatttgttttgcacagctaaaataatgaggttaaataatgcccaggtatgcaggtcaattgacctttttaatagcttaacgaaagcatttgacaaatggacaaaagaaatcacattgtatttctttgtatctctccattcctcttacccttccccaaccctctactaaagaatatttcttatttagtcaggaaatcttatgtaatatttttggacggtccataggaaaagcaagatgaaactctcaggcagacaacataaagcagctcccatatctgctagaaaggtcattaattttcagaatatattgttgaaataatttttattttcaatacttgtagtctttccactcagaggactcttatttggcttgaatgtggaaaaggcatctggttcaggtcagtaaggactgttgtatgtaagttttactctagaaaatttggttttagctttgatgacacctagcgtcagtggaatgcaatgaatgcttaatacttcggctttataatgtttgggcatttctctttaacatcctcaaatacactttcatccttgaaaacacaagcctattttctgtttgaaatgaagagaaaggtaattgacagataaacagatagtttttgtttgaagagccaatcaagtttctctttgtactcagtagggactaaaggaagcttaaggataatgacattgtcttcatatgaagaagaaattttttactagtggaaaattagaagtaaatctaccaaattctgtttgtaaattttaaagaccaccacaaaagaccttgaaaaaagtgaaactactgcaagattactgttgcttattgaaagtaataatacagttttattttttccactttataactgcccaagggctcccccaaccagctatatataagaaaaccataacatgaactagggtctttctattcaaaaaagaaatattaaactaacataagcaattctgaaggaagacagtggtaggttttcagatggtttgttaagaattatatgtaaaaggatactagatattatgttttggatgttttctaagtatctatgaaaattattttttcctaaacgatttcataattgattacttttgacctcagttattttggggcataatccttttactactctataaagaagttctacttctacctatatgaatttgtattttcccatatgccaaacacacacacataaattttctttttctcatttcagctcatataattcagttagtgaaatatttcactcttctgtaagtttaagaaaaattcctaagcagtgatacaactttgggtcgctattttagtaaaatgaagagtctctagactttttttttttttttaatgatctctgacttcactaccatatgtgcagcacaacagtgacatcttaaggccaagtaaccagagctcctttagccagagaaagaacttgaattgggatctgatttcaaagaaatcccattatattatcaagtcgttttcaaatttacaatattcgactggtaaagaaagtgcttctttatgacttcttttgcagtctttgtgaaccttttaatgtgcaatagtaaacattgacattttacatagacatattgtatattaatgcatgcatttcactgcatagtttattgacactacccttgtaaagcttttatggaagaaccaacaagccacagcagtatagcaaaagaggcttaatctttataaattggggccttttctgtctctttgctagcctaggtggctgtatacaaattcgggtgggagggggcaggaaacacctcttcacatttaaggttttctacttgggtgtactctagccaattcaaaacaaattgcttactttaataatacaattttaccattttataaaaaaaatcaaatcacaacatgtttaactgaaatggctgtattgtaattaatattttgagataattgtgattttgagcttaaattatatataaaaaattgtcatttttgtatgtgttaaaaagactactatatcacaattaaaagtactttttagttgaactacatattgatgtaaataaaactgaatgaagacatatttactactttattaacatagatcgtgaatgtacttactggtttttttgcagtatgagaccataacaaccttgaaagctgcttcattttatgtgcaaagaagtcctatgaatctatattttaaatttactgaaccagtgaaattaattactgtcagttaatttgcaaatgcaagctgtattctccagttttattttatgtactgacactaattggtaaaggtgtacaatgtgattagaatgcattttgaagatgctttctgtacagatacaaaatacagggactaaaataatgctgtgcagtgtatagcagagccatttttcggctttggtgtactcaactttttcagtatttaaaaaagtgttttgaataacataaaagtctccttattgtataaataataaaatgtcaccttattgtaaa

SEQ ID NO: 11722 - DNA, 390 bp, Homo sapiens
  ENST00000441830
tggcacttccgaggtcattcataaacaggcacagaggagcaaaaaattggagtcaccccacgggcatgttcccaggcactgggacaactcttttccaaagaaagacccaaaaatcgtacaaataagtccaaatgaagcatgatgggaaatcagggactaattctgcttggaggacagggaaggctttcaaagctcttacaatgaaacatggcaataaacaaaatctcatttactgttggaaagatctgggagcaatgttagaagaaaagttaacaaaaaggtaaaaggattttaggagccaatataactactaataatgaaaatacctgtgagaaaattattcccaactagatgactacctattacaaataaatatttttctctaaccta

SEQ ID NO: 11723 - DNA, 3996 bp, Homo sapiens
  ENST00000415775
ctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaaaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacatta

SEQ ID NO: 11724 - DNA, 1655 bp, Homo sapiens
  ENST00000416796
tggcagcgttttccccagaacatccccaagcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagaggcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcagaagttttccaggcatctgcgaatgcattgtcaactctcttagaacaaaatgcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaa

SEQ ID NO: 11725 - DNA, 4740 bp, Homo sapiens
  ENST00000343742
gcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctc

SEQ ID NO: 11726 - DNA, 9158 bp, Homo sapiens
  ENST00000298910
ttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactt

SEQ ID NO: 11727 - DNA, 556 bp, Homo sapiens
  ENST00000474202
gttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccagtaagtatgatagatatgtaaaacaaatggccttgagtatttatttgtacacatgacaaccttcccttgatacactgtgtttgcaatccaaggctactcctgtggaattctttaaaatacagatatttttccttgagtcaatgatttacatttatagagagctttaaactcagaagtttgatttagaaagcaaacatttaaggtaacatgtcagaagttattattttaataatataatcatataattataaaactggttaagttgtagatttttgatgagtacttttgaattcaaaccatgaagagattttggcttttaataatagaatcgatacaaaccactagttcttaaaaaaatgggaactgagaaaagttagttctgtaagtagtaatttgaaag

SEQ ID NO: 11728 - DNA, 6400 bp, Homo sapiens
  ENST00000430804
cactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacagctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaa

SEQ ID NO: 11729 - DNA, 8306 bp, Homo sapiens
  ENST00000479187
agaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggcaagtttctttcctttagatatttttcatattctctaagtcttataaaatatgcctttattttacgtttacattttctctgaactttccagtgtcatatggatggtcttggagggtcacacagtgaaacataagactggtataaattgtgaatagggtcattacagaagtggagggagtaaatgctctcagtcccacaagagaagcagattactgcagctgaacactcagtttgggtcttacttgcttttttcctttttacctaaggcaaaaatgggaaatacatggtattgaatatattttactttttgagcaaagaaaataaagaaaatgtttgttttaatcatagtctagcctcccagcttgttaaagaatctcatttggtttttcattctataacaaatcttttttcttgcagcaatacatgctgaactgcacaacctacaaatattgacaaatcatattttactcaaactttgtctttttttgcttctatttttatatttaaatatgataaaattgtgatagcacataaaatatattttctgcataaatatatttgcgtcttcctttgataataatttgttttagaaaataacaataatagcatatatacaaaagtttacaaaaacgacactatggggtttaattctgaaaaaaactagaatttatgtaactttagcaaataatgaatgttttgaacatggtgaagaaaatatattcattgcaagtatatgtgaaagaggaacatgtgtttttctagcaccttcacctatttttcatttatagactttagagttgcacaggagttacaattagatgctcttaatgactgtaaactattaagatacatgtccacacaagcagagcagtaggtctctcaataggttgtctcagtagtcttattctaccaaagttgttgcattctctagttgaattgtatgtactttgggacccaaatagcttgcttataactgaagttatagtggaatgtctatgggttatagtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtgtttcataaatttgtagaaaatattacatatggtataatcaggaattttaattggtagtttatagtgtaaagaacttagacataaattttcaaaattacaagtgatatgaagtgttaaatatttatattttcagctgaagtagaggtgtcaatcactagctcaaccttaaacgaaatgtgaatattttttacaacttatctatatctacataatgtctaattttgaacagtgtttgaaaaagcttttatttcttttagaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaa

SEQ ID NO: 11730 - DNA, 561 bp, Homo sapiens
  ENST00000481256
agcaggcatctctgtgggccttgagacgtagtcccgtaaaactcatcccgtttctacttgatttgctttctttgagaactcttgtttatttttatatggaggtttcctgccttggattaaaacataaacctcaatctgaagttcaatttcatcttaatttatgaacgactaagagagggaacatgaaaagtggagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaattt

SEQ ID NO: 11731 - DNA, 2477 bp, Homo sapiens
  ENST00000636518
aactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggcca

SEQ ID NO: 11732 - DNA, 2976 bp, Homo sapiens
  ENST00000409911
ctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaagaaaaagagaaaaaaaaactgcttgaagagggcagcgaatgcacctgcagcattaccgggaggactgcagaactttctttgctttaaaacataaaacaaacaaaaatgctcccggatgtaaatagtaagagtgtcaagttcttataaaaatagatttcaccctagctacatataggtttgtttgtatatttgatttttctacactgcatggttcctgggctggagaaccacaggggagcaaataaacaggggtgggtgggaagctagggaaacaaccgttttcctctttaggtgtgtgtaattctcacagattttatttaaattgctttcatttattttttctttaaaaatgctgtttgttcttgttttgtttgttttaatttttttctttcctggtcaagtttctaatacaaaacatgagcattaaagcttatgttgtaccaaaagaaaatgtgctttaccacggaccacggagaaagttgaccacaaagtttgacaaaactactggaaaacccaataagtctgggtgaatgacccttcatgacaaatgccatatatggtacatgatagaaggaattttgttttgtcccattggcagccctcactgtgtaggatgcctgagagagccatgaagatctccgaatgagaagaccagcagaatcattctcatgtggactaaggctataagagagatatgaccatgggctcaatgaatgaaactgccaagctgacaaatttctaaacacaagataatgtgtaacattgctttttaaattaattatcaattagcttttgtgtagtttttatcaataaaagaaaaaatattgaaaaataaatata

SEQ ID NO: 11733 - DNA, 2227 bp, Homo sapiens
  ENST00000409884
aaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaagaaaaa

SEQ ID NO: 11734 - DNA, 2247 bp, Homo sapiens
  ENST00000409093
acaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaag

SEQ ID NO: 11735 - DNA, 3616 bp, Homo sapiens
  ENST00000409088
agtgtatcacaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttctttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccctggtaactaaaatcaggtcacaattttgtggatgatttagcaataataaaatggcagtcataacagggactgtttgtcagtattgctgtcatccccaaaagaaatgatatgtattcttgttaaacttattaaaaaataagtgatacaaatatttataaataaaaggagagaggtttgagttctgggtatcctccctttctgtaacagcctcaaataaaggtgtaccttccatgttatattatttttgtttttataagaataaatttggacccggtttctgattatttaatttaaaagatcacttacaggatcatgttagtgagcagacaaatagtcacaaatttcaaacttgtcaataagtaatgctggatgtaaattgttcttttcttggtaatgttgatcattatgtgcaaagactgactactaaggccttgttgctggaagaaactagtgaagagaggttaaattctggcaatataatgttttagtatctgattttagatgatcactctttcaaaagacagttttaatgagtaattaaagatgttgccctttctaatgctagttaacagttggaaaatataattgctctttgatagcatatactccaatttttccatagtcctaactacaaatgctaatgaaaatgttttcagacaaagcactgaatttgaaataatctctaactcagtacaatttggactattgaactgttcttcaaagaattcattttcttcttttttgtgtatcattgaaaataagagaagtaatcccagataataaattcctaaaaggaaactgtataagcaattgcccttaaaaattaaaaagaataaaagattttctat

SEQ ID NO: 11736 - DNA, 2451 bp, Homo sapiens
  ENST00000409282
ctcatacagcacaggaggcctacttgcttcaagaactgaaaatccagaggatgaattgctttatctgggaatggcaaaagccagcacaataaggaatgccaggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttctttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccc

SEQ ID NO: 11737 - DNA, 485 bp, Homo sapiens
  ENST00000456154
aagactccgtgggcgtaggaccctccgagccaggtgagggatataatctcgtggtgccgttttttaagcccgtcgaaaatcgcagtattcgggtgggagtgacccgattttccagatgctgtctgtcacccctttctttgactaggaaagggaactccctgaccccttgcgcttcccgagtgaggcaatgcctcaccctgcttcggctcacgcacggtgcgcgcacccactgacctgcgcccactgtctggcactccctagtgagatgaacccagtacctcagatggaaatgcagaaatcacctgtcttctgtgtcgctcacactgagagctgtagaccggagcttttcctatttggccatcttgcgacaaagtgatcccaggtttccatttaattacgcagctgaaaggcatgagtgtggtgctggtgctacttcctacactgctgcttgttatgctcacgggtgctcagagagcttgcccaaa

SEQ ID NO: 11738 - DNA, 596 bp, Homo sapiens
  ENST00000491242
cacccagttcgagcttcccggctgctttgtttacctaagcaagcccgggcaatggtgggcgcccatcccccagcctcgcgcctccttgcagtttgatctcagactgctgtgctagcaatcagcaagactccgtgggcgtaggaccctccgagccaggtgagggatataatctcgtggtgccgttttttaagcccgtcgaaaatcgcagtattcgggtgggagtgacccgattttccagatgctgtctgtcacccctttctttgactaggaaagggaactccctgaccccttgcgcttcccgagtgaggcaatgcctcaccctgcttcggctcacgcacggtgcgcgcacccactgacctgcgcccactgtctggcactccctagtgagatgaacccagtacctcagatggaaatgcagaaatcacctgtcttctgtgtcgctcacactgagagctgtagaccggagcttttcctatttggccatcttgcgacaaagtgatcccagcttacaggtcatacagaaaacaagcagcctgtccctgatgtacattaaaaacccacctttgggtaaggaaagaacaagggtctatcattct

SEQ ID NO: 11739 - DNA, 1423 bp, Homo sapiens
  ENST00000273286
ttgaaagcaacaactgttttctgcattgaagaaaagcaagggcagggttcagaaagactgaatgtaaagctgggctctgagtctgccatgcccttcgtgtgttgctctgcacattaattaaagggtctacgaggtcagcaaggacgcccaaggagactcagtcatgaaaggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaagaaaaaaaaaagatgtgtctgtaaaaaatatttctggggaggaatttatgttgcgatttttaaaatactataggtaaaataaagatgatacttgtg

SEQ ID NO: 11740 - DNA, 1318 bp, Homo sapiens
  ENST00000493075
aagcctctgaaatgcaccatgtcggtgcccaggctcattctgctctgccttaagtgtccttcgttctctggaccacagccttcccaagaatgaggacctgttcttgctccctgctggacccctgcctccagcaagatgctgagtacacagacgacccataggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaa

SEQ ID NO: 11741 - DNA, 2258 bp, Homo sapiens
  ENST00000450169
gcttttcaaagtcgtcccaccatcaatgaaggcaggccacttccggcgtagccatggcggctaacgctactaccaacccgtcgcagctgctgcccttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaagcagctaagaactccaggactcaggtcaaatcaaggaactgataataagatcattgaactgtataaattaagtcaaagaactcctattaaaaacaaacaggtaatatatgcacatcgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttttttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcactttat

SEQ ID NO: 11742 - DNA, 740 bp, Homo sapiens
  ENST00000409909
acgtgacccgggcggctgggcttgcagagcctgtggtgtccgcgggacctggagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaa

SEQ ID NO: 11743 - DNA, 538 bp, Homo sapiens
  ENST00000409292
tcactggaaaaggtccacatttagtgaacgcgtcgtcggcctactttgttgtgagcccgcctctgcagtgttatagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtca

SEQ ID NO: 11744 - DNA, 636 bp, Homo sapiens
  ENST00000468872
aaaaaaaaaaaaacccaaaaaacatttcatttcatatttgatttcctgggcaagctttcacttctttttatgaagctctgtctgatagacgtgggtcttagtgtcagtgagttcattctgctgcttttaatgaaggttacattacctagtggataacctttgtatctgaaaattgtggatataattgctcaacctcagtgtaatttgtatacaaggataacctttttagggagggtaagtatttccaaaatgttggctttgattttcactgtttgtcctgactgtattttatctattcatttagtgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 11745 - DNA, 687 bp, Homo sapiens
  ENST00000410044
cggctaacgctactaccaacccgtcgcagctgctgcccttaggtaatcgccgtcctttggggagcaggaacagggagctgacattcaggattgggggccgaggggctgttccgaggcaggccctggccgagtgtggggaaatgtataagaccaaatgcggttcgactctgagctccaagtcttcgcgacagcaggccgcacctgctctttaacgtggtcgggctcctccagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 11746 - DNA, 504 bp, Homo sapiens
  ENST00000409987
acttccggcgtagccatggcggctaacgctactaccaacccgtcgcagctgctgcccttagagcttgtggacaaatgtataggatcaagaattcacatcgtgatgaagagtgataaggaaattgttggtactcttctaggatttgatgactttgtcagtatccttttaaaagtgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 11747 - DNA, 1295 bp, Homo sapiens
  ENST00000223084
cttaaatcctcactaaagaaaaattttaaaaaatgctagttgcagattttcaatccactggactttaaaaagaaacaatagattccttaatgagtagttgtaacgaaaattgtaacagttaattgatggcaggaaatacgaattgatttatactggtttgaagattctggcttgagaggaaatgcaactttacgggggaagaagactcaaacgttacaggaacaatttattcacaaggcaaaatatcttcaacgtctctccaaaacttcaagggcattatgggtatctgccgagatggtaaaatgtccagtgggcaggaaatatttcaccggatctcacttgccggggaaaaaagccagtgaacgcgacccacgcagctgactagatcgtgcgctcggcctcagattggtcgagcctgtttgggctgcggaaaaagcggaagcgcgcttttcaaagtcgtcccaccatcaatgaaggcaggccacttccggcgtagccatggcggctaacgctactaccaacccgtcgcagctgctgcccttaggtaatcgccgtcctttggggagcaggaacagggagctgacattcaggattgggggccgaggggctgttccgaggcaggccctggccgagtgtggggaaatgtataagaccaaatgcggttcgactctgagctccaagtcttcgcgacagcaggccgcacctgctctttaacgtggtcgggctcctccaggcaaggactttgacttctcaaaccagaccttcactggaaaaggtccacatttagtgaacgcgtcgtcggcctactttgttgtgagcccgcctctgcagtgttatagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 11748 - DNA, 649 bp, Homo sapiens
  ENST00000409782
acttccggcgtagccatggcggctaacgctactaccaacccgtcgcagctgctgcccttagttggtgaagagtgattgaactagtggtcgtggccgtgattgaaaagttttcattccttcatgccacagactcttttggaaggctcattatgtgccagatgctgtgcttgaactgagatttgtattataagacctaaaagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttg

SEQ ID NO: 11749 - DNA, 687 bp, Homo sapiens
  ENST00000409952
ggtgtccgcgggacctggaggtgcggcgtggcacacctgctttttcctccctggattcaatctcaaagcacttccttctcttttgccttctctttttcctcaaagttttcccacttccctcttctcttctgttttccttgctttttcacatcttttcggttcactctccgagtgtccgattccttcacctccttgcctttgcctctgtggcccccgtccttattcttaaatatgtagtaacatggagcatactggtgagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgc

SEQ ID NO: 11750 - DNA, 1736 bp, Homo sapiens
  ENST00000480956
gtagccatggcggctaacgctactaccaacccgtcgcagctgctgcccttagagcttgtggacaaatgtataggatcaagaattcacatcgtgatgaagagtgataaggaaattgttggtactcttctaggatttgatgactttgtcaatatggtactggaagatgtcactgagttgtgagtagtgttaaagaattggggggaatctcttcttaattaaagacagttttactacttttgagtaaaattatttatgagaaaacattacctcttggtggaataacgttaaagatagacgttttatctgtttgcttgtaaaattggatcagagtgttattaccttaatgtaattattagtaaacgcctagaatattagtggagacacagttttaaggtagaagataacaaaaagagccaggaattttagggttcaggtcaaataaaggaactgatagtaagagcatttaggctggacatggtggctcattcctgtaatcctagcactttggaaggccaaaggaggaggattaagcctgggagtttgagaccagcctgggcaacaaagggagacccctgtctctataaaaaatttaaaaattagctggttatagtagggggcagctgtagtcctagctgctctggagggtgaggatcccttgagcccaggagttctaggctgcagtgaactatgattgtaccactgtactcagcctgggcaacagagcaagaccctgtctcttaaaaaaaaaaaaacccaaaaaacatttcatttcatatttgatttcctgggcaagctttcacttctttttatgaagctctgtctgatagacgtgggtcttagtgtcagtgagttcattctgctgcttttaatgaaggttacattacctagtggataacctttgtatctgaaaattgtggatataattgctcaacctcagtgtaatttgtatacaaggataacctttttagggagggtaagtatttccaaaatgttggctttgattttcactgtttgtcctgactgtattttatctattcatttagtgaaatcacaccagaaggaagaaggattactaaattagatcagattttgctaaatggaaataatataacaatggtaagacacattgaaactgttttattttgatgggagcccatttttggggagcagtgattacagaactaaccttaatgttgcttgcttgactaaatgatcatggcccagtggtgcataagatgggaaaggggttctctgtggtcagggtcctaaagctcagctattgaagaggcattgggtctaaaggttagtttgcttggaacttttaatcgctgttgagatagtaagtattaattgatgacgttgggaattgtaaatagatactgacaatctggagaaaatgggaacgtggagtgcaggggacaggcaaaggtggcttaatgaagagcaaggggtttttagatgacatggtggtagtgttattaataaactctttttcctctttatgcagctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttcttt

SEQ ID NO: 11751 - DNA, 8567 bp, Homo sapiens
  ENST00000261978
cctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaa

SEQ ID NO: 11752 - DNA, 6462 bp, Homo sapiens
  ENST00000553939
tcgccgcccgctggcttcccggtgccaaagtgggtgttgctggaattcctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccaggtctgtgttgctgcaaaactggggaagaggtgggcaccaaagctgtttcacttccatctcctccacctgctagtcatattgccagcaggagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggg

SEQ ID NO: 11753 - DNA, 863 bp, Homo sapiens
  ENST00000554861
cacttcccaaaaacacgatgtgaaggtttaaacaaaacacctcaccccttccccacgcccaaacccaaaaactatgtagcaacacactcctcgaccacccaaaccccagcaggagccgggcattgtggaagcagcgagtctcagcctccctggagccctcatttgaagcccagagcacctctccccatctaaaatgacacatactttttttttcaagagtactgccttttgttctagcatctttccacaagaattttatgatcctctctgcccccacccccacagttccacaggggcaccctttgtccagaagggcgagggtcccagcattagggagagtctggacacagccctcagcctcctcctctctccgatttcctcctcccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctcc

SEQ ID NO: 11754 - DNA, 5614 bp, Homo sapiens
  ENST00000556690
agggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctc

SEQ ID NO: 11755 - DNA, 699 bp, Homo sapiens
  ENST00000556206
cacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctggga

SEQ ID NO: 11756 - DNA, 582 bp, Homo sapiens
  ENST00000557425
agccgtgcgagcccagctggagtaggagcgcggactcgaggctcggggcgcgcagccctcgttccgccgagagccgggcccccagtcggccgcttcagggccccctagactcagagaagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcact

SEQ ID NO: 11757 - DNA, 2940 bp, Homo sapiens
  ENST00000355166
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 11758 - DNA, 3046 bp, Homo sapiens
  ENST00000263800
gccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatc

SEQ ID NO: 11759 - DNA, 3444 bp, Homo sapiens
  ENST00000563518
agctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcggggtcccggggctgacttcaagaccactcaccgcagcagagccgtggtagactcctctgggattctaagataggaaggagctggggaggcctggggaaaacgtttaccttaatgagcatctggaggggtgtcctgggcaggtgggggagggagagttgatgggcaggtggagggtgtgccgttattcttcccacccccagtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtgagttgagtgctgcccgggaagggaggtccttcacaaccatgggtgggcatgaactcctgcctctccccaggtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatc

SEQ ID NO: 11760 - DNA, 1821 bp, Homo sapiens
  ENST00000561619
ccgtggcaaaatgagctgtcaactttaggttgacaggggtgtggccgcgaccgcaagggcttttgttgccgggtggacccaacagggatgggctgctggggacagctgctggtgtggttcggagccgcggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccc

SEQ ID NO: 11761 - DNA, 2412 bp, Homo sapiens
  ENST00000453182
ggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtggggcttggcccggcccagtcctggcctctgccaccaggtgtcaccgaggtttccccagccaatgttactctgctcagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactg

SEQ ID NO: 11762 - DNA, 582 bp, Homo sapiens
  ENST00000569283
ttcttttactcacagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatgggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccag

SEQ ID NO: 11763 - DNA, 1854 bp, Homo sapiens
  ENST00000371980
ggttttgctccgctttagcagcggcgaagggaggacccccgggagccggtccccggcgtccggtcgcccagcccttttcaggcttgggcccgcatggaggggaccgtggagtcccagacgcctgacctgcgggatgtggagggtaaggtgggcaggaagacccctgaagggctgctccgcgggctgcgaggcgagtgtgagctgggaacctctggcgccctgctgctcccaggggcgtctagcaccggccacgacttgggggacaagatcatggcgctgaagatggagctggcttacctgcgagccatcgatgtgaagatcctgcagcagctggtgaccttgaatgagggcatcgaggcagtgcgctggctgttggaggagcgggggacgttgaccagtcattgcagcagcctcaccagcagtcaatatagcctgacaggcgggagcccaggccgctcaaggcgaggcagctgggacagcctgccagacaccagcaccaccgaccggctggacagtgtctctattggcagcttcctggacacagtggcccccagcgagctggatgaacagggcccacctggggctccacgttccgagatggactgggcaaaagttatagctggtggagagagggccaggactgaggtggatgtggcagccaccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttgtaatcctgtggctcttttatccattagatgtggtctcccccaaaattgattctccctcagtctgagactaggaagaggctgcactgaaatcagttaccatggaaacctggctcatcatttctctagtccctagggagtctctgcctttatccctcaattattgggtccctagagctagcttgctctttctttctttctttctttttttgagacagggtcttatgctgttacccaagatagagagcagtggcatgatcacagctcactgcagccttgacctcctgggctcaagcgatcctcctatttcagcctcccccatagttaggaccacaggcatgcaccaccatgcccagctaattgtttatttatttattttttttttgtagagatagggtttccctgtgttgcccaggctggtctcaaactcctgggctcaagggatcctcccgcctcagcctcccaaagtgctgggattatgcccagcccctagagatacttctatagagatattgactctaaaggattgacctatggcttttggtatttagtatctctcactactccccccagctaagtaaggatttaaggaatttaggactccctggagttaacagatgaagagatgggggcataattacttcacccaaagtctagaagccttggcctctctcttggccaagatggaggattgaggagggacatggaccttcaggactaaccctctatggattggccctcccagaagcgtttgggctggtagacccaccccttcctacctgctgagtgatgtcatttcctgccaggatgggtagccctttgtacgggtccttggatggtagtaggtcatataggggcatctgagcccctgctgctaagtgagatcacattatttatcgtccataccattacttcttgtgaacagtaacatgtcactcctcctggcaggaaagtttctcattgtcagatgtttgtgcttcttttcaggtcttactttttaaatagagtgttctcattttatccta

SEQ ID NO: 11764 - DNA, 1753 bp, Homo sapiens
  ENST00000319264
atgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgaggagatcttgatcatcttagtgtcggaggagtcgcagcggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggacccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacagttaa

SEQ ID NO: 11765 - DNA, 739 bp, Homo sapiens
  ENST00000489107
ctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggacccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttggacaaaaatttaaggacaacccttaggtacataatggagaagctggaaagtggaagtcatcttgatgagtttgcaaaatagatgaaaagataaaatggaaaagatgacaaaccaacaggtcaggggatgcctgataccgtatcacaaagatcagacatacgtgtggagactaacaggtaaaactattttccacaagaaaatttcttgtacaaggaattaagaatgttgctaactctgcaaattaaggacttaatatgagggacgaagacatcaaggagatgaggaaattttattcctaaccatgtcttctgtaattttacccatggaatgttaatatattcacttaatctaataaataaatcttgttgaaacata

SEQ ID NO: 11766 - DNA, 1335 bp, Homo sapiens
  ENST00000517503
gaacagcccagcctggagcgggaagcagggacaagatgacctcaggaatcccaggctgcgggggtgcctgcgtcctcccctcccgagctccactccgcaggcgagacccccaacactgctccccgacactctccgaggcacccctcctccgtgctcacacccaaacacgtctgctcacccgtgggcttcccaccccgaacacaacgaggactgtccaggtgtcagtgacggtcaccccgacctggtcccctgtccggcctcgccaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccag

SEQ ID NO: 11767 - DNA, 1181 bp, Homo sapiens
  ENST00000292494
cccggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagct

SEQ ID NO: 11768 - DNA, 1173 bp, Homo sapiens
  ENST00000429120
ccggggccgcgcggctgcctgggaggctccgggccagccgcggtccagagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccag

SEQ ID NO: 11769 - DNA, 1256 bp, Homo sapiens
  ENST00000521699
cagccgcggtccagagcgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagc

SEQ ID NO: 11770 - DNA, 490 bp, Homo sapiens
  ENST00000520531
cagagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctagcccgggccggggctcagcagaggccattgctgtctgtctgcagccgtctgtctctcccctgacagcctcatttcccatgcagggaatctcgtgacatttggccacagcctgagcaagacctgttccccggcctgccccatcccagaaggcgtcaatg

SEQ ID NO: 11771 - DNA, 1419 bp, Homo sapiens
  ENST00000520466
cagagcgcgcgaggttcggggagctcggccaggctgctggtacctgcgtccgcccggcggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 11772 - DNA, 740 bp, Homo sapiens
  ENST00000521003
agagcgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacagagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttg

SEQ ID NO: 11773 - DNA, 606 bp, Homo sapiens
  ENST00000522528
agagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccc

SEQ ID NO: 11774 - DNA, 857 bp, Homo sapiens
  ENST00000522971
ttcggggagctcggccaggctgctggtacctgcgtccgcccggcggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctggggg

SEQ ID NO: 11775 - DNA, 635 bp, Homo sapiens
  ENST00000519611
cggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagacc

SEQ ID NO: 11776 - DNA, 1079 bp, Homo sapiens
  ENST00000521182
gggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 11777 - DNA, 971 bp, Homo sapiens
  ENST00000519546
tcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagc

SEQ ID NO: 11778 - DNA, 427 bp, Homo sapiens
  ENST00000523847
cggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaa

SEQ ID NO: 11779 - DNA, 868 bp, Homo sapiens
  ENST00000522024
caggctgctggtacctgcgtccgcccggcggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatc

SEQ ID NO: 11780 - DNA, 656 bp, Homo sapiens
  ENST00000519615
ttgcctgacctcagagggagcccctccccagtgctctgccctttcttctgccccaggttcagcaggtcaagtgagttcctcctcccacagcggaaggaggtgttggggggcatggaggaaagaaagcgggtgcaagaaggagcacgctcaggctggggcagcacccagggccgtaggacttgggaatggagggtgtctgtctggacccgctggtgcagagggtacaaaagctgggctggggcaggacagacgggccggagtgtagtgagtggcctgtgggaggggcagggggctcccacgcagaagctctgggcagcagccctgacccatccgtgcctggactgcagtgctgcccgcttccccctggcaaacaggtggcagcctcctgacagaggaagccggcccaggccgccgtgtctgcagttgggtgctgtgcgctgcccagagggctctttgggctggagagagaaaacaagaacagacacccagtggaggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgcta

SEQ ID NO: 11781 - DNA, 1335 bp, Homo sapiens; identical to SEQ ID NO: 11766
  ENST00000633898

SEQ ID NO: 11782 - DNA, 1181 bp, Homo sapiens; identical to SEQ ID NO: 11767
  ENST00000619718

SEQ ID NO: 11783 - DNA, 1173 bp, Homo sapiens; identical to SEQ ID NO: 11768
  ENST00000632424

SEQ ID NO: 11784 - DNA, 1256 bp, Homo sapiens; identical to SEQ ID NO: 11769
  ENST00000632519

SEQ ID NO: 11785 - DNA, 490 bp, Homo sapiens; identical to SEQ ID NO: 11770
  ENST00000633934

SEQ ID NO: 11786 - DNA, 1419 bp, Homo sapiens; identical to SEQ ID NO: 11771
  ENST00000632812

SEQ ID NO: 11787 - DNA, 740 bp, Homo sapiens; identical to SEQ ID NO: 11772
  ENST00000632516

SEQ ID NO: 11788 - DNA, 606 bp, Homo sapiens; identical to SEQ ID NO: 11773
  ENST00000632232

SEQ ID NO: 11789 - DNA, 857 bp, Homo sapiens; identical to SEQ ID NO: 11774
  ENST00000631568

SEQ ID NO: 11790 - DNA, 635 bp, Homo sapiens; identical to SEQ ID NO: 11775
  ENST00000632902

SEQ ID NO: 11791 - DNA, 1079 bp, Homo sapiens; identical to SEQ ID NO: 11776
  ENST00000632978

SEQ ID NO: 11792 - DNA, 971 bp, Homo sapiens; identical to SEQ ID NO: 11777
  ENST00000632618

SEQ ID NO: 11793 - DNA, 427 bp, Homo sapiens; identical to SEQ ID NO: 11778
  ENST00000633551

SEQ ID NO: 11794 - DNA, 868 bp, Homo sapiens; identical to SEQ ID NO: 11779
  ENST00000633451

SEQ ID NO: 11795 - DNA, 656 bp, Homo sapiens; identical to SEQ ID NO: 11780
  ENST00000631680

SEQ ID NO: 11796 - DNA, 1891 bp, Homo sapiens
  ENST00000397463
ccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaatgaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgt

SEQ ID NO: 11797 - DNA, 1033 bp, Homo sapiens
  ENST00000345008
gaaatgaaagaagggggagagggagggagggagggagagaaggagcctgaggcagatatggaacgatctctgcagaggaattacaaagaaagtcatttaagcccctttacagaccagctctgctgggaggatgcagaaataaatgatcagcgtcccggcgtgagagagctgcccccagaagtggccgggggagaaaagggtgaagaggagctaaagcttaggaggcgatttccacggaaatggatgctccctaaggatgtgcggaaaggggatgggaatgtgcggattgggggcgggggcaccaacgcactccggcgggcaagcggtctcccgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccgga

SEQ ID NO: 11798 - DNA, 578 bp, Homo sapiens
  ENST00000449209
agtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctc

SEQ ID NO: 11799 - DNA, 4071 bp, Homo sapiens
  ENST00000334166
gagtggcgcgcgcgcccctagccgccccccgcctctccccgctgcgctccctcgctccttccctgagctcccgggctccggcagcgggctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtatcttaccaggctcctccctgcaaatgcacatgtcaatcaatgattaatgcacccaggttatgtacaaggcactgggcttagcaccacagggaacttccttccagaggcttgctttctagttgtgtagacaagaatacatgcatgagaagatacaagacaattcacccatgccaaatgattcatacaggctgtttaagtactgcagaaaataaaagaaggaaaggctaccagacttttcaataaggtctacagcttcccaagagcatgtctttgttaaatcaggaaatataaaaattatgtgtgtatgtgtatgtatatatatataccaccctattaactattttaaaatcgtattctattttgggggttgtgttaatgatgatgaaccagaaaagattttctcttgatggtttcttcaacaggaaacagatattggaatagtgtacatgtcatttttatctatacaatgaatttattatatttttcttagtaaagtgatagacattgaaagcaagcttgaaaaa

SEQ ID NO: 11800 - DNA, 1204 bp, Homo sapiens
  ENST00000418762
agtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatcaggtgtccaggagtagaagataggaaaaaatatgcagaccatgctaaggatgcacatttttcatcgtgcatggtcaaaagttgtggtactatgtctcaaggtatatacgaggcaatgaggagacagtttggagcctccatcaaggagaaccagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttg

SEQ ID NO: 11801 - DNA, 565 bp, Homo sapiens
  ENST00000414420
agcactgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaa

SEQ ID NO: 11802 - DNA, 1580 bp, Homo sapiens
  ENST00000392854
gggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcagggtgagcaacaaggcactattttggaagcagagaacagccctcaccagacacggaatctgctggtgccctgatcttggaattcccaccgtctagaactgtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatcaggtgtccaggagtagaagataggaaaaaatatgcagaccatgctaaggatgcacatttttcatcgtgcatggtcaaaagttgtggtactatgtctcaaggtatatacgaggcaatgaggagacagtttggagcctccatcaaggagaaccagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaa

SEQ ID NO: 11803 - DNA, 3578 bp, Homo sapiens
  ENST00000409381
actgcaaacgtcaagtggtctccgccttccctgggttcggagcttcacttgctcttgagctctgcggtccggcggatttcgcggggcccaggggatggcggggagtgagatttggccagggtcatttcacactgccgggcctgcagccacgcacgcagctgctggcccggctgaggctggcggctagggagaggcgccagggggtcgcgcacaggaaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgt

SEQ ID NO: 11804 - DNA, 589 bp, Homo sapiens
  ENST00000473800
aaagctctggtgattcagtagtggacgggactctgctggagcaggacttcagagtgtttgttttcagcctgcttttaaagtgatttgaagagagtggctttgaagtgtgtgccttcggcaaaagaggcatacctccaaattcagctgattactcagctattcaatatcagcgcgactgaagggaacctagccatctccatgaaggggtgcttctccgccagagccagtctccaatgtagcaggtgacaaggcgagcaggaatgagcccaaaccagggaacatctggaaccctcaagggaactgcgaatgcttcgtttttctccagtagaatccccttctgcatccctgtattgagcaactgcactcaccaaaggcagaaaatagaaaggaattggggtgggacatcacagccctaaaaagccctaaaagacactgaattatgaatttatagtaactagtgaaaatgctgcggcttaagtaatgcttggcaaaccatcatgtatagttgtgtctattgatcactgcccaagggcaccagccaagagctgaaggggggccaagatccacctcatgtgctgtctggcagaag

SEQ ID NO: 11805 - DNA, 1577 bp, Homo sapiens
  ENST00000409642
acttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 11806 - DNA, 1248 bp, Homo sapiens
  ENST00000409876
cgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaa

SEQ ID NO: 11807 - DNA, 1306 bp, Homo sapiens
  ENST00000409029
ctctgctggagcaggacttcagagtgtttgttttcagcctgcttttaaagtgatttgaagagagtggctttgaagattatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 11808 - DNA, 545 bp, Homo sapiens
  ENST00000480545
agtgtgtgtgctggggctggggcggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttgttccttaaggttgccagcatgaaagtgcttcagatggctttgagtcctaatcttgtggttctgttcactgaagataagcagcaattttttgattattttattttcctatggattgccaataggtctaaataacctccttagttgtactggcaggaccaagtaaaaagacaagggatgaaaaggagggaaggaaaaaaaggaaagaaagagagaaagagcgaggaaatatgagaaagaaaaagaggagggaaagaggaaagagagaattgtcttgggaaggtgatataggccactaattactttagagctgcaagcctcct

SEQ ID NO: 11809 - DNA, 572 bp, Homo sapiens
  ENST00000473975
agtgtgtgtgctggggctggggcggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttgttccttaaggttgccagcatgaaagtgcttcagatggctttgagtcctaatcttgtggttctgttcactgaagatcagaaactgaaaaaacaacctgaaagttggcaaagaaaggattctgtggtttttctaagtctctcaagccagtggacagccacggcactcagcataattgggctgattactctgagtgcaaaccttttcactgttccagagaggagcctgacaaccacattctccttctcaaggtgtggtgcttactgcgcaggctgaccagatataagagttcggaccgcccagcacacaaggtcagcatgctgctcctctgtcacgctctcgctatagct

SEQ ID NO: 11810 - DNA, 528 bp, Homo sapiens
  ENST00000437627
gtgctggggctggggcggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctgacacattctaattagtctaaggaaaatggtgacagaggatatattccgtaacgtctcaggaggtcgcctggctccagagagtgtaaaatgccacacgttggatgagatgattatccgagctcagacttgggaaatagtcatgcttctggaccaagtgccaggta

SEQ ID NO: 11811 - DNA, 484 bp, Homo sapiens
  ENST00000450639
cggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttgctgattactctgagtgcaaaccttttcactgttccagagaggagcctgacaaccacattctccttctcaagatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctgacacattgtaggtgccccgtaaatattggttgagtaactgaataaacgtatttagtaacttaa

SEQ ID NO: 11812 - DNA, 515 bp, Homo sapiens
  ENST00000442722
attatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccacaagtaaaacgtctttgatatactttattagagagtgattcttataaataaaaaattatttggtatacatgtgggtacctgtagttcccacgcctggaagagtatcagaatcatgatgaaaggatttttaactgcatatccctaatcacttctccagagatttaacagtcaagaggctacaccatttccaaatagcttcaagtgctttacttgtgaaaacgcaggggata

SEQ ID NO: 11813 - DNA, 1719 bp, Homo sapiens
  ENST00000498249
gtctgctatcatttaccttatggattcctgtatatgcaaccctgcccatgctgcatattagaaacttctgctcagcttttaaaaaatactggtgttctggccaacttcacttaagaccagttaaattcgaatcttggttggcgtggctctgggcaatggcgtttattaaaagctccccggaaactgaaaaaacaacctgaaagttggcaaagaaaggattctgtggtttttctaagtctctcaagccagtggacagccacggcactcagcataattgggctgattactctgagtgcaaaccttttcactgttccagagaggagcctgacaaccacattctccttctcaaggttttgaaagagttgcaaaatttatcaaatgcaaatgttgactcaaggaatggaactgacagataggtggtccagtgactttggctcaacatgcctcagaaccacggttgatttgagaaatccagtgattcagcacagaggaaaccagctagccgcagtcactgagggaatggggtgcagccaggccagctctgcctgcttgtcattacttacctttcatttgatcaaaaacaatgcaatttactcgcaggtcctggccctacacaacagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 11814 - DNA, 1100 bp, Homo sapiens
  ENST00000280115
atgcgatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatg

SEQ ID NO: 11815 - DNA, 500 bp, Homo sapiens
  ENST00000564457
tccccctagggctcctacctcacagcgctcacccaggacagaggaccagagtctgcaccccctccagggcagctccaaccccatatccccaggccctgggttgaggggtgctggcggtggggaggcagggacagtaggtacccaacccccgccccttcatctctcaatgcccccccgccttttcctcaactccccccctccccaaaactcacagctgctccagaggttcctccagtcaaaccctttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaa

SEQ ID NO: 11816 - DNA, 857 bp, Homo sapiens
  ENST00000568663
aggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaactta

SEQ ID NO: 11817 - DNA, 1399 bp, Homo sapiens
  ENST00000412082
tttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaactcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 11818 - DNA, 931 bp, Homo sapiens
  ENST00000567165
gcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccagtaagtgtgactccggttaacaagtgctgggtacttaccctcatcaacctggttatttccaagaatgtgtaacaagagggcgagtgcttgctgagaagcccagagctgctgtgggaggcatgttggaaataagctatcattgcatgctgccagcccatcacaacaaagtaaaatgtcaatgaatgcatgacgtatcctgcttacatagctttccacgtatggaagggaaaaccagctcacactgtagagctttttctcttttcactttcatcttttttatggaaatgtgtttaattataaaaggcaggtttgttgttactaaaagaataaagttcaaacatgaaaggaatgcataaagtagaaagtaaaaatggtcaaaaattctcatccaggctggtcttgaactcctgggctcaagcaatcctcccacctcagcctcccaaagctctgggataacaggcatgagccaccgtgcctggccagaaatcttttttgtttgttcgtttttttggagacagagtcttactctgtcgcccaggctggagtgcagcatg

SEQ ID NO: 11819 - DNA, 769 bp, Homo sapiens
  ENST00000569023
aggagggagaatgggagaggggcaaggagggaacgagtggaagattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaa

SEQ ID NO: 11820 - DNA, 1695 bp, Homo sapiens
  ENST00000568820
agattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccagtaagtgtgactccggttaacaagtgctgggtacttaccctcatcaacctggttatttccaagaatgtgtaacaagagggcgagtgcttgctgagaagcccagagctgctgtgggaggcatgttggaaataagctatcattgcatgctgccagcccatcacaacaaagtaaaatgtcaatgaatgcatgacgtatcctgcttacatagctttccacgtatggaagggaaaaccagctcacactgtagagctttttctcttttcactttcatcttttttatggaaatgtgtttaattataaaaggcaggtttgttgttactaaaagaataaagttcaaacatgaaaggaatgcataaagtagaaagtaaaaatggtcaaaaattctcatccaggctaggcactgcggctcatgcctataatcctagcactttgggaggccaaggcaggaggatcacttgaggctggtcttgaactcctgggctcaagcaatcctcccacctcagcctcccaaagctctgggataacaggcatgagccaccgtgcctggccagaaatcttttttgtttgttcgtttttttggagacagagtcttactctgtcgcccaggctggagtgcagcatgatttctgctcactacaacctctgccttcccagttcaagtgattctcattcctcaacctctcgaataggtggaactacagtcgtgcaccaccacacccagctaattttttgtattttaatagaaacagggtttcaccatgttgcccaggctggtcttgaactcctgagcttaggcaatctgcccaccgtggcctccaaaagtgctaggatgacaggcgtaagccactgcgcccagcccaaatttcttaaaaaaaaaaaaaaaaaaaaaaaatttctcattgtgcagagggtgaacactttaactgttaaatggaaaattgccaatattcaactcttttagctacaaaaacagcaattttatattgtagtggctcaacctaattagtttggtagtatacccttttagtctttttttctgtattcatgtacctacattttctttacatatgtaggattctggatataatgttatactgcgtacttattttacttcatgtcttctgcacatctttgtatgtagctctccctcaatctttttttttttt

SEQ ID NO: 11821 - DNA, 931 bp, Homo sapiens
  ENST00000562740
tgttggatgcggcgggagatgggtagagtcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaa

SEQ ID NO: 11822 - DNA, 460 bp, Homo sapiens
  ENST00000567954
cacggctctgctgggctcctggcgccgcctcctcccagcccgccgcgggctgcgcgcttctgtgggtgggggaaggcaggactgacgcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaa

SEQ ID NO: 11823 - DNA, 1659 bp, Homo sapiens
  ENST00000396052
gcctggtgtggggacgctcaggtgccggcgtggggccccctcggaggctgtgaatcttttggacccccgaatgtaaatgggagatgagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 11824 - DNA, 1558 bp, Homo sapiens
  ENST00000439021
tttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 11825 - DNA, 1626 bp, Homo sapiens
  ENST00000219168
ggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 11826 - DNA, 904 bp, Homo sapiens
  ENST00000287748
gtcatggagaactcttgggtgcagacaagtggatgattaatgaagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgtgcccttctttcccttcagagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaacttgg

SEQ ID NO: 11827 - DNA, 838 bp, Homo sapiens
  ENST00000441172
aagtagcatctgaaaaacccaaggaaccaaatgtaggtggagcaacttccctgcaacacacgtcgaagctgctgcagtggctgttcttcccctccccttggaaaggcaccaaaagccagcctttggaagggctggtggactgagaaccagtgtccctgtgactccacccactcatctggccaccgttgccctgacctgccaggagcctggagaagatgaaggcatccgtggttctctccctccttggctacctggtggttccaagtggtgcttacatcttggggcgttgcacagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaaccaaactagttactcaa

SEQ ID NO: 11828 - DNA, 639 bp, Homo sapiens
  ENST00000470991
agaaaataggaggtcaagaggaggagaaggggcagagtttcaggtgtcccagatttgcagtgacacgaagcagagaattaggatgggaagaagtgtcatggcttaccagtggctaagaaactccacgatggaggcctggattattttgagggctatagccttgagaactgggtgtgcctggcctacttcgagagcaagttcaaccccatggccatctacgagaacacacgtgagggctacactggctttggcctctttcagatgcgtggcagtgactggtgtggcgaccatggcaggaaccgctgccatatgtcatgttccgctttactgaatcctaatttagagaagacaattaaatgtgccaagaccattgtaaaaggaaaagaagggatgggagcatggcccacctggtcccggtactgccagtactccgataccctggcacggtggctggatggttgcaagctgtagccacctgcatggcccctgcagcactcaccagttgcatcttgtgaatgaaggtgcttttctgcttgctgcttcagtcaatccttttgatgatctcaccactttaagagttccagatggaaaaagacaaaagtttgcttcatccggggatgcaggatgcagaataaacca

SEQ ID NO: 11829 - DNA, 1865 bp, Homo sapiens
  ENST00000468630
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggttttcctttttttgttttcttgttactttcttgttaaattttctcccttgattttatcatcacacagcaccattataataaaaattaatgaaatgatgaaaaagaaa

SEQ ID NO: 11830 - DNA, 4433 bp, Homo sapiens
  ENST00000273390
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaa

SEQ ID NO: 11831 - DNA, 4356 bp, Homo sapiens
  ENST00000482573
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaa

SEQ ID NO: 11832 - DNA, 939 bp, Homo sapiens
  ENST00000463700
gacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtgagttggtaaatctcctgactattggcagatgacgatgctgataaccacgcatgctgttcaaatggcccatgtacaggcaattgtggtttacagtgttgctatataaagtgtcttagtacagcaacttcatagactcataatttttctgatacttctggtcaaataaagatactatctttttattgtga

SEQ ID NO: 11833 - DNA, 2712 bp, Homo sapiens
  ENST00000482927
gtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacggtaaggaccgccgcagaccttcctccgcgtccgtcgcctcctaggccagatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaac

SEQ ID NO: 11834 - DNA, 475 bp, Homo sapiens
  ENST00000488533
agtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaattt

SEQ ID NO: 11835 - DNA, 1021 bp, Homo sapiens
  ENST00000469659
agtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaagtaagtaaccattatttgaaaactctttttcagtttatttattgtttgcttccatattttttcttagaagatagttcactaaatcactatttttcaaattgtggatcacaaaacattagaagggtatgaaatcttctagtgtgtcatgagcagcattttaaaacatgaaacagaatagaaaataaccaaagcatcaagtatatggagggtaagttggtttttgtttataacttttgtttcagaaaaatatatgcatatgtttatatgtatatgatggattatgatataaaatgtatttcttactgttagttgtccatttgtgctgctataacaaattaacagattgggtgatataaataaaataaatttatttcttgaagttctgaaggctgggcagtccaagaagcaaggcagtccaatgggcagtcagtgtcggtgagggccttcttgctgtgtcttcacatgg

SEQ ID NO: 11836 - DNA, 2353 bp, Homo sapiens
  ENST00000475093
aggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacatttt

SEQ ID NO: 11837 - DNA, 3140 bp, Homo sapiens
  ENST00000483134
gacttgtttctaaatcacaattcccaaattattaatttctatggagaaatatgtgttaccatgttatctagactagctggtcagggtatttgcctccccagagacaagtctacttgggaaatcaagtgtatccaaaggctgcttgttaatttaatggcaaatcagttgattttaaagggtggtacagtatagtcaatcatgaatattcttcatcactttaaagatatacctgataaacagatacttataatagcagggcaatattttgttgaactttgtaaaaataacagttccatcatcagcaaacttacaaacttaaggggtgaattctgaagatagctgattttttttttaaccgtgttcaccaattctgagatatcatgtggtttgcatctttctagtgcaccaaatatgggagatggtataaatgtattgcttctttcacttgcaaattggcatagtgcgtatatacaaggtctttcccttgaagaattttttgggttacccaggctcaaaaggagttttgttcataggagagaagaaagtgtgttcagggtgtagtacttgaaaacatgctagactttctttatgaattccacttccgtaagctgacttggaatactcagaaaagaaaaacatcttgacaactgttgctggtagaagtggtagagtaacagggccacatgcacaacagagcatgagctgctgcagagtcagacaatatttaaacttttaaatttgttttccaattaagagattacattactttgccattattctcagcctaggggtagatatgttctatctgttatgctacttgattgtttattttgcagatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaatttatttcaatgggataaatttaataatatatgcccatgttaaaagaattcaagtagtataaaagcatatacagtgtgaagtaaattctagccctatcccctaccccctccacataaacagccattgtcatcagtttcttgggcatgtatttaaagatattttacgcatacagcaataacccctcttcttatgctgtatacattgttttgtatgtttttaaaaagagtttacaatgtaattaaaatgctttagaaaagctgatggtataattttgtcctttgcctcccttctctaacattagagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaatggagtcttgctccatcactcaggctggagtgcagtggcgtgatctcggctcgctgcaacctccacctccagggttcaagtgattctccttcctcagcctcccaagtagctgggattacagggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggttttcctttttttgttttcttgttactttcttgttaaattttctcccttgattttatcatcacacagcaccattataataaaaattaatgaaatgatgaaaaagaaa

SEQ ID NO: 11838 - DNA, 535 bp, Homo sapiens
  ENST00000498167
gaatggaagggacataaggagaaacacagagaagccctccggcagctcaccacatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaa

SEQ ID NO: 11839 - DNA, 381 bp, Homo sapiens
  ENST00000461322
gtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatggtgtgtaggtccaaccgctggccctgcatttctcttttgagaataaatttttta

SEQ ID NO: 11840 - DNA, 554 bp, Homo sapiens
  ENST00000470948
aaatccaaatttttttgtggagttaaacaaacttgccaggaatgtgatatttcagatcacttaatcaaggaaaagccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaag

SEQ ID NO: 11841 - DNA, 454 bp, Homo sapiens
  ENST00000482995
tgagctcataaactcatcatcaatcatgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttca

SEQ ID NO: 11842 - DNA, 949 bp, Homo sapiens
  ENST00000472117
atcatcaatcagtaagtcccttccacattaagaactaaggctcaaagagaagtataagactaggtctttatatttgtaagttacttacactctagatatcaaacgaaatgtaactcacatgaagtgcttcaatgctgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggc

SEQ ID NO: 11843 - DNA, 563 bp, Homo sapiens
  ENST00000496010
aatcagtaagtcccttccacattaagaactaaggctcaaagagaagtataagactaggtctttatatttgtaagttacttacactctagatatcaaacgaaatgtaactcacatgaagtgcttcaatgctgaatagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagtccttggtccaatagaatggaatcttaagtctcaatcaaaaggaatcatggaaggagggttgagatgagagggaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttc

SEQ ID NO: 11844 - DNA, 845 bp, Homo sapiens
  ENST00000475543
gtcccttccacattaagaactaaggctcaaagagaagtataagactaggtctttatatttgtaagttacttacactctagatatcaaacgaaatgtaactcacatgaagtgcttcaatgctgaataggttggtacaaactcaagtgcgtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaaca

SEQ ID NO: 11845 - DNA, 1217 bp, Homo sapiens
  ENST00000569649
atggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtacccaagggaatcctctacatcagtgatgtgaaaaaatccagttgcctgaagtcaaagaggtacatcttgatttttgatttgcatgtgcttgagttt

SEQ ID NO: 11846 - DNA, 2646 bp, Homo sapiens
  ENST00000326043
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaaggctattaaatgtagtagttaactatgcctcttgtctgggggtttcatagagaccggtaggaaagcgcactcctgcttttcgatttatggtgtgtgcaagtaaacaggtgcattgctttcaacctgccatactagttttaaaaattcactgaaattacaaagatacatatatatgcatatatataatggaaagtttcccggaatgcaacaattagcattttaaaatcatatataggcatgcacattctaaatagtactttttcatgcttcattgtttctctggcagataattttactaagaagaaaaatagatattcgactccccttccctaaacaaatccacgggcagaggctccagcggagccgagccccctggttttctcgtaggccctagacggtgttgcatttatcagtgatgtcaaacgtgctcatttgtcagacatagctgtaaatgaaaacaatgtgtggcaaaatacaaagttagttaaataca

SEQ ID NO: 11847 - DNA, 6384 bp, Homo sapiens
  ENST00000393350
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggccccctacacacacacaaacccgcacgcacacaccacacacacacacacacacacacacacaccccacaccctgctcgagtttgtggtggtggtggctgttttaaactggggagggaatgggtgtctggctcatggattgccaatctgaaattctccataacttgctagcttgttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatcctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgattctgtactcagtttcttagtgtacagtttaactgggcccaacaacctcgttaaaagtgtaaaatgcatccttttctccagtggaaggattcctggaggaatagggagacagtaattcagggtgaaattataggctgttttttgaagtgaggaggctggccccatatactgattagcaatatttaatatagatgtaaattatgacctcatttttttctccccaaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaataatacctgtgtggaatataggctgtgctttgatttactggtatttaccccaaaataggctgtgtatgggggctgacttaaagatcccttggaaagactcaaaactaccttcactagtaggactcctaagcgctgacctatttttaaatgacacaaattcatgaaactaatgttacaaattcatgcagtttgcactcttagtcatcttcccctagcacaccaatagaatgttagacaaagccagcactgttttgaaaatacagccaaacacgatgacttttgttttgttttctgccgttcttaaaagaaaaaaagataatattgcaactctgactgaaagacttatttttaagaaaacaggttgtgtttggtgctgctaagttctggccagtttatcatctggccttcctgcctattttttacaaaacacgaagacagtgtgtaacctcgacattttgaccttcctttatgtgctagtttagacaggctcctgaatccacacttaattttgcttaacaaaagtcttaatagtaaacctcccctcatgagcttgaagtcaagtgttcttgacttcagatatttctttcctttttttttttttttcctcatcacaactaagagatacacaaactctgaagaagcagaaatggagagaatgcttttaacaaaaaagcatctgatgaaagattttaggcaaacattctcaaaataagagtgatattctggatgtagttattgcagttatctcatgacaaatgaggcctggattggaaggaaaatatagttgtgtagaattaagcattttgataggaatctacaaggtagttgaatataataagcaggtttgggcccccaaactttagaaaatcaaatgcaaaggtgctggcaaaaatgaggtttgagtggctggctgtaagagaaggttaactcctagtaaaaggcatttttagaaataacaattactgaaaactttgaagtatagtgggagtagcaaacaaatacatgttttttttttcttacaaagaactcctaaatcctgagtaagtgccattcattacaataagtctctaaatttaaaaaaaaaaaaatcatatgaggaaatctagctttcccctttacgctgcgtttgatctttgtctaaatagtgttaaaattcctttcattccaattacagaactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaa

SEQ ID NO: 11848 - DNA, 3284 bp, Homo sapiens
  ENST00000624676
ggcaacatggcaaaaccctgtctctacaaaaaaaaaaaaaaaaaaaaaaaaaaaaaaatacaaaaaatgaacctagcatggtggtgtgtgcttatggtcccagctacttgggaggctaaggtgggagaatggctggagtccaggagaaggaggttgcagtgagccgagattgtgccactgcactccagcctgggtgacagagtgagaccctgtctcgaaaaaaaaaaaaaaattcagaggtgaagactgctttaaccagggtggtcaggaaatgtctctctgaggcagtgacatccgggctgacgtgaaagatgagaaagagtcaggcaagtgaacagaagaccagacagccagtgccaagggcctgtcgcaggaatgagcttggtatgtttgggggacagaaagaagggcactgtggccgaagagcagtggatgaggagagagtggccaaagaaggtgtgtaaacaacctgagctttgttttgagaagaacattggctggtatagaaagaaagactttggaggcaaagtagggagcctcggaggctgctgccattgtccgggtaagctgatggtgccgagaccaggtgccatgactggaggtggtgagaaatggtcctatgcaggagacctggagacaccgctagcttgagtcctgaggtggggaggaagggagagggagggatggagccaggctccaaggttttggcttgagcagctgagatggggtggcaagggagcagaggtagggctgacgatcaggagcgggtttttgggccgagtcctctgcagtgcccatctgacacccactggatgcgcagagtgggcagctggctatgagtctggaactcagagaagctgttcgctccggaaatacaaacctggggctcatagccatataaatgtcatttaaagccacgggactggatgagatcattaaggcagaaggtctaggtcgaaagaagagggccaggaccactacctgtaaaatgagccaatgacacctacacccacggggctctcgcgaggtgtcacgtgaacgcacccagcgagccctggaaccaggcagagaatcgcggcagccccgggggcggggcttccagggggcggggtcatacgggggcggggccgagggaccaagcggccgctcctggccggagggcggccgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtgaggaacgcgggaccaggaggacggtgcgcgggaccccaaggcggcagggtttctgcgtcccgggatgcgcctggggtgggcgcccgggcccgatccgtcggggctcccggagctccatcgcccggacggctcggggcggggagaagggagcggccgtcccggggacgccgaggacggggccgaggccagctcgggggagtgggggtggagacggggccccttcccggggcgcgggcgggtaggcggcggcgccgggaggaaggggcagcgcaggccggcgatctccgcgtccgcccggcgggggcgggggcgctgtgctcctacgtgactcggtgggaacaggccctggcccggcgcccgcgggcggtgcgtgcgcggtttgtttacgtccgagggcgggcgtgtgttccctggcgggcggcctgggtatcctgcccggtgcgtgcgtgcgctgtgtacctcgggggcgtgtgtgcgtgtgttgtgcttgtgtgtgcgtgtccgcgcgcgcgctccctggggcctgtacaccagcagtgtgtacctcggagagggcgtgccctgggccggccaccggagtaaacgcggaacaaggacccgagcgaaggaagcggacccgtgcgtcttcgcacggggtctgggaattctggcccgggccgccccagtcctactacccggggctgtccgtccccggctctccccggagtttcccagggcctccgccacgtgaccccagtgtttgtctcccgcccagagcccgcgcccgcagccacagggtggggcaaggtatcaaagaccccacccagctgagctaggagtgagggatgtgagccacccccgcttggcaccccggtggatctggtaacaaagtgagttggagcccaggttcttgtccccagattttggggcttcctggggagggaagaaccaagggactctcgttcgtccccagggttgcccatcccctcagtcccatgagaacaggaagggccagaaaaccttgactgcaagggtgcggcgcagggagaggaccacaggcttttagctagtccgggttctggaggctgtacctgctaggtcgtggaggatggggcggagccggtttccgctctcctggtagtttcagttcacaagtgggactggtgagactagactgacctacagctggacgccggaagctagctgaggctctgagccagccgacagaccccgagtgccctcaccctgggccaggcagggtcagtaggcattggggatagaactctgactgcacggagggttaatgagtgaggggtggggcctgacctagccgccacccacccactcacccaatagccctgcagaaagcacctgtttgtcgtagccgcctgcaggatgggctgggggctagagattccttggtcttaatccaccttccccctccacccacccacccacggtctatggaattgtgggaggggagcaattgaacttgctagggtgaggaaccaatgatcttttgactttggatctttgaaccctgggtgagctctgctacagcagcccggaccctcagtattcccatctaccactgggaactaggtaacagccaggatggcaggatggtgggtagaagggggaagctctggaagtctgtgcagacagcgtattttccaggtgaattgtggaagagaaagcagggctgacagccccatgccaggagctgggggtacccaagagtaggtggggtttgagtcaggagggttggggccaggagcacaggaaccagacaggcccaccctcaaagctgggcaggaaacattacaaagtagggcctggggtcaggggatgagggg

SEQ ID NO: 11849 - DNA, 2490 bp, Homo sapiens
  ENST00000338483
acgggggcggggccgagggaccaagcggccgctcctggccggagggcggccgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagagaataaa

SEQ ID NO: 11850 - DNA, 548 bp, Homo sapiens
  ENST00000441709
ttccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccg

SEQ ID NO: 11851 - DNA, 697 bp, Homo sapiens
  ENST00000417948
aaacgcggaacaaggacccgagcgaaggaagcggacccgtgcgtcttcgcacggggtctgggaattctggcccgggccgccccagtcctactacccggggctgtccgtccccggctctccccggagtttcccagggcctccgccacgtgaccccagtgtttgtctcccgcccagagcccgcgcccgcagccacagggtggggcaaggtatcaaagaccccacccagctgagctaggagtgagggatgtgagccacccccgcttggcaccccggtggatctggtaacaaagtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgg

SEQ ID NO: 11852 - DNA, 2325 bp, Homo sapiens
  ENST00000407965
cagaatggtcaaagaggacctcctgaggaggtgacattgggcaaagacctaaatgatgaggagtcaccatggggctagaacagtaaagagcacagcctgtgcacagctcccgcggctggaaggagccattcaaggaggcctgtggaccaatgtggagagaggaaggtggcaggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagag

SEQ ID NO: 11853 - DNA, 2365 bp, Homo sapiens
  ENST00000538999
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 11854 - DNA, 2216 bp, Homo sapiens
  ENST00000426621
agctgagctaggagtgagggatgtgagccacccccgcttggcaccccggtggatctggtaacaaagtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 11855 - DNA, 2458 bp, Homo sapiens
  ENST00000538320
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtgaggaacgcgggaccaggaggacggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 11856 - DNA, 559 bp, Homo sapiens
  ENST00000600291
aagtgggggcctagaccctggaaggcaggggactgcgagctgggctggcggagcagaggtgcagaagcaactgagtccaagttgtctggcggcttcaggtggacccagaagacgtccccaactcagggagattcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggagg

SEQ ID NO: 11857 - DNA, 2390 bp, Homo sapiens
  ENST00000392213
aagtgggggcctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 11858 - DNA, 2426 bp, Homo sapiens
  ENST00000361922
cctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagtccaaagaggtttctaccctggaatctcactgagtgccccaggagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 11859 - DNA, 585 bp, Homo sapiens
  ENST00000595791
actgcgagctgggctggcggagcagaggtgcagaagcaactgagtccaagtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagct

SEQ ID NO: 11860 - DNA, 542 bp, Homo sapiens
  ENST00000597035
gagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctgacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcct

SEQ ID NO: 11861 - DNA, 2341 bp, Homo sapiens
  ENST00000537831
gagctgggctggcggagcagaggtgcagaagcaactgagtccaagttgtctggcggcttcaggtggacccagaagacgtccccaactcagggagattcaggtaacggctgacaggtgctggggacctaaaggctttggcccctgagcaggttggagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 11862 - DNA, 545 bp, Homo sapiens
  ENST00000593348
aaggagtctccggggccgggcctcgcgttggctccgggccaccctcagacctgattttgcccctgcagtcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagaga

SEQ ID NO: 11863 - DNA, 575 bp, Homo sapiens
  ENST00000597162
atcgtctgctacattacccagacacgcaggaaaaagaacgtgacagagagccccagcttctcggcaggggacaaccctcccgtcctgttcagcagcgacttccgcatctctggggcaccagagaagtacgagtccaaagaggtttctaccctggaatctcactgagtgccccaggaggtaggttccgggggcctcagtgtgccctcctctgggccctccttgggccctggggttggcgtgcatgtccgtgtgtccctgtcaggcgtcaaggtggtctctggtgatgtccgggcctgcccggcagtgctggccttgtctagtctgtcctgttgcagctcccttctgtctgtggccaccgtcctgtgtgtccaaattcctgtggctagggggtggagggaggggtgggaagcgtggggggaacccacatgtcacctgcaggacctcccagattgagggcggacccatgcaggacccatgggggggcacgtaccaaaccaggtatttccaggaatttggaaagatggggtcctgactaggtggttttcacccaaaaaggtattaggggttacattgtg

SEQ ID NO: 11864 - DNA, 559 bp, Homo sapiens; identical to SEQ ID NO: 11856
  ENST00000600291

SEQ ID NO: 11865 - DNA, 2390 bp, Homo sapiens; identical to SEQ ID NO: 11857
  ENST00000392213

SEQ ID NO: 11866 - DNA, 2426 bp, Homo sapiens; identical to SEQ ID NO: 11858
  ENST00000361922

SEQ ID NO: 11867 - DNA, 585 bp, Homo sapiens; identical to SEQ ID NO: 11859
  ENST00000595791

SEQ ID NO: 11868 - DNA, 542 bp, Homo sapiens; identical to SEQ ID NO: 11860
  ENST00000597035

SEQ ID NO: 11869 - DNA, 2341 bp, Homo sapiens; identical to SEQ ID NO: 11861
  ENST00000537831

SEQ ID NO: 11870 - DNA, 545 bp, Homo sapiens; identical to SEQ ID NO: 11862
  ENST00000593348

SEQ ID NO: 11871 - DNA, 575 bp, Homo sapiens; identical to SEQ ID NO: 11863
  ENST00000597162

SEQ ID NO: 11872 - DNA, 3911 bp, Homo sapiens
  ENST00000369617
ctcctggggacaattcccttttcctttcttcagcctaacccgcggtggccctcgcggagtccggtcagccccggggagcgcagccgggaggggcgtccaaggggcgtctcgcgtctgggaacggccgggcccccagcgggctgtggtcgcggggtgggggccggagcggcgaggccccccttaccgggctgcgcgggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatttcactcttgtcgcccaagctggagtgcaatggcatgatctcggctcactgcaacctccgcctcctgggttcaatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaa

SEQ ID NO: 11873 - DNA, 6430 bp, Homo sapiens
  ENST00000307546
ccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 11874 - DNA, 6508 bp, Homo sapiens
  ENST00000369615
gggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 11875 - DNA, 3596 bp, Homo sapiens
  ENST00000369611
cggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaa

SEQ ID NO: 11876 - DNA, 897 bp, Homo sapiens
  ENST00000486456
tccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggtatgtccccaaataacatcactaccacccaaaaaactatctgaacgactggaattatttcagagggaatttgaccagtaaagtaccactttttgaaaaactttttttcctctctgtttttgagaaaattttcttttgatggggagatttgtaatttattaattaaaatgggattaaataataagcaaaaaaaatccatcatattttaaagttgattgtgaacagtatactaaaaatcagccagactggccagtttatatatttcatagtaattcacattcatcatgtgaactcagtgagtatttgttgattgcattttatttgtggttggaattcaaaatctgtactttaaaaaacttacatgtaccttgactatcctggaaaaaagagaatataaaatttggggagaaaacaacaaaaacagaataattggttttcttt

SEQ ID NO: 11877 - DNA, 890 bp, Homo sapiens
  ENST00000477955
gacgcctgtcagcgggctcaccaaccgggacaccctggctgtcatccgccacttccgcgagcccatccgtctcaagactgtgaaaccagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtagttggaataatcatagggccaagggattttaacatctgtagtaactttttgtcctaggttagcttgtatctctcccacctcccataactgctgctgagacatctatgtttgatatcatttgacgtcaacctcccctgcaagccacaggcagggagagcacctcacccaaagcaaccagtttattggctggtcagcaacctgtgatttctgtagcttaaaaagatgagtggggcttattgtcttttgaactaagacaaaaaggaaagaatttccaattaagggtgggagcttcagctgagaggttttgaagtgagttggctgtattcttttgcaagaccaattgttaaattttcaagaattttgtgagttgtcaaacagccatttttaagaattaagttgcataataatttaataaaaacaaagataaatactcaaaa

SEQ ID NO: 11878 - DNA, 4047 bp, Homo sapiens
  ENST00000358075
agaaatcaaccttcttttagcgggcgtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatctaaa

SEQ ID NO: 11879 - DNA, 2788 bp, Homo sapiens
  ENST00000618282
atagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctc

SEQ ID NO: 11880 - DNA, 959 bp, Homo sapiens
  ENST00000476168
ggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttggtgagtgaatttcagaagacaaaaaattatttgaataaaattcctaatagtgtatttttaggtaagcttttatttatgtgagaagtagcattttatttcttacctgaggaaaatagttttatatattttaattttctgtcttaaaatcagtttgtttcattcattatctcataaggatggccagaacttcaaggaactgattgtacctgccttttattcaacctaaatgacagactgtcatctctatgaaaatctctagttgttctgaaaata

SEQ ID NO: 11881 - DNA, 962 bp, Homo sapiens
  ENST00000373336
gtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgtttcaggttttttgagatggagtctcgctctgttgcccagactagagtgcagtggcttgatctcggctcactgcaacctctgcctcctggattcaagtgattcttctgcctcagcctcctgaatagctggaattacaggtgcccaccaccacgcctggctactttttgtattttgagtacagatggggtttcaccgtattggccaggctggtctcaaactcctgacctcagatgatccacccacctcagcctcccaaagtgctgggattacaggcgtgagccaccacacctggtccatttttagcttcagcatctctactagttctttccccttgcatataaatacttaaggacatagattcaattttgtctttgtttataaatgtgtctaattcatatatttgaacatattttactcaattgtatcaaacataaaaggaaaaagctggatataatgccttgctatacatcttcatatgaatgacttcccaatctaaaaatttattatatcccaaattaaactgttttctcttccactttca

SEQ ID NO: 11882 - DNA, 4019 bp, Homo sapiens
  ENST00000610432
gtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaaaagtaagaaagaaaaggactcccttagaatgggaaagaaaaatcataaaatattgagctgatgcctgtatatagaaattaagcgtttctcgaaagctgttctatgttttgctgttattttagtctttattctcttcctttaggtggagaaacaaagtaccaatttgaagggattttttttattttgtcttttggtttctgtcagtagaaataaccatatgtgctaaccaaatttctgtgaagaatgttttcatggttatcattatatctaactataacctcccccatagttatgaagagtaacctgaaatgccactattgtggaaataggataattgtaattgtgaaaaaataattttaaggaaatcttacaagtattacattaaaaagatactatgactgccacctgccatttaccttctaataaccctgccatgtggtttgcagaaagagatggatatagtagcctcagaagaaatattttatgtgggttttttgtttttcgttactagatttcatggatgaggggatatggttgaccttttactttttaatggagcagccagtttttgttaattactcacttgtaaattgtgagattctgaattccttacctgctattcttgtacttgtctcaggccaaatctatgctgtggttcttatgagacttgtatgaagatgccctgatttgtacagattgaccacgggaatactactgccatgtaatctgtatagttccagataatttgtcatgaacattgacagaatgacaattttttgtatttgctttttctccctttaagagcacattcttctgtaaggagaaaggcagcattctggctaaaatgtgtagaaggtaatttactacacttataaaatagtgtgacttttgtgaaaattttgaattagctttcatatgaagtgccttaagtagactcttcatttacttttctggtaatggtttaaatatcatttgttatgcatttttaagatacagttcagaatgacacattgtagtggcaaagataaccaaatgtctggctgtttgctttttgaccatatcaataaacttttacaatct

SEQ ID NO: 11883 - DNA, 3984 bp, Homo sapiens
  ENST00000313243
gcaggcgcggacaggtaatccccagcgggctgcagggccaccaccctctgtccgacccagccggagcccgacctgcgaggctggccgggcatgtcccctcggcgccctgtgctaccagggccaatctccgcccggagaccggtccctgacgccgggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 11884 - DNA, 3859 bp, Homo sapiens
  ENST00000474039
cgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaa

SEQ ID NO: 11885 - DNA, 3941 bp, Homo sapiens
  ENST00000354489
tcctaggagatgaaacacacaagacgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcagaagaaagcataattaaaccaatcgaaaaactatcatgcaatgaaacttttcctgaaaaattagaggacccacaaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcatt

SEQ ID NO: 11886 - DNA, 3767 bp, Homo sapiens
  ENST00000536370
tcctaggagatgaaacacacaagacgccggagcttcacaagggagcgaacgaggtaagcagcaggcgcggacagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcatt

SEQ ID NO: 11887 - DNA, 2459 bp, Homo sapiens
  ENST00000538030
agggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcgtcaacaggtgaagatggctgttatttccctctcagcacaccagtttcccacgttatgaatccaactgcagccgttgcaggacagatagaaacatgttacacacaagcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcatgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagt

SEQ ID NO: 11888 - DNA, 547 bp, Homo sapiens
  ENST00000489399
ctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgatgacaatgttccaagattgactgtggtgatggacgcacgtatctgcgaatattctgaaaaccagggaatcataccctttcaatgggggaactgcatgggctgtgaattatagctcataaagctgtttaagaaaagaaaaagataatgtctccccaccatctcactatgaaacatactgctataaatataccatgcaaaggaaaaaagtcggcctcattttttaaaggactcacttgcaaggtgatgcccccagaggctgggtggggtcctgagatctgtcaggagctggggttaaacccatagtgggctttgttctatggacaactgtggacaa

SEQ ID NO: 11889 - DNA, 1112 bp, Homo sapiens
  ENST00000309988
cccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 11890 - DNA, 873 bp, Homo sapiens
  ENST00000353004
atggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 11891 - DNA, 831 bp, Homo sapiens
  ENST00000354078
atggcccccgcagcggcgacggggggcagcaccctgcccagtggcttctcggtcttcaccaccttgcccgacttgctcttcatctttgagtttgacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 11892 - DNA, 705 bp, Homo sapiens
  ENST00000349807
atggcccccgcagcggcgacggggggcagcaccctgcccagtggcttctcggtcttcaccaccttgcccgacttgctcttcatctttgagtttgtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 11893 - DNA, 573 bp, Homo sapiens
  ENST00000522112
agattccatgggcgtaggaccctccgagccagggcaagaagttgcaggaaaaatggcttctagcagtggaacttcctcatacacgtgatctgtttctgattagagaactgcaggaggtgaaaattgggttcaagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttg

SEQ ID NO: 11894 - DNA, 578 bp, Homo sapiens
  ENST00000534619
ataagcaccccactttttaagtgtgactggtgacctcgattttaccttctgagtcacagcaccaagacctgtgtatctgtcaaactgagcacagtgggcgagggcgcgctgtgagagctggggagaagacaggtggagagcacagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagttt

SEQ ID NO: 11895 - DNA, 2818 bp, Homo sapiens
  ENST00000614891
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataa

SEQ ID NO: 11896 - DNA, 892 bp, Homo sapiens
  ENST00000531508
gaacattggggacgtggaggaaagaaaggtgttggggctcagaggcgcctttagaaacccagggcatggccaggggccgcgcttggccggagcgagctcctggctctcggcctcgcctgttgctaacctgccattttgttgggtggtgcaaaggtgtagccgatgactgggtgacctggtggctgccacgctgtggaaagtgggggcgggaggcaacaggaagaggaagagggctgaggacttgaacatgctttttccccactcacccttgccatcattagtggcctttggattggaaagaggagctgggcaggaggcagggcaaggagaaagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatgg

SEQ ID NO: 11897 - DNA, 1837 bp, Homo sapiens
  ENST00000318083
agactcaacccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagatctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcagagacctcatggatgttcttacatgcccccgaccccggtagatggctccctgttgtttggggagcctggaaggtggttatgccttttggatgcaggagaggagcaagaaagagtggagagggagaatgggggagccggaccctgacctccctgggttctggttggagatgaaaaaattagaagcatcaggtctaagatcagcttctcttggaagcagagcctgagacaagatataaatgccagtcatttattaaa

SEQ ID NO: 11898 - DNA, 1825 bp, Homo sapiens
  ENST00000356751
gaatggcgctggcccgcggcgctgcgctggcagggagcaggcgggaggcccgaggaagggagcctgctgcccgcccacccgcctgcacaggctgtgtaagggggctgggcacgcatatcccgccaacaactgcagctcccaccagcctgccaggccaggctcctggacactcccttcccgccttcctcctcccacctccctcctccctccacagtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcag

SEQ ID NO: 11899 - DNA, 1693 bp, Homo sapiens
  ENST00000594582
gggggcaggtggagccgggggcagggctgcctccagcctgcacgctggctggctcgtagccccagaatggcgctggcccgcggcgctgcgctggcagggagcaggcgggaggcccgaggaagggagcctgctgcccgcccacccgcctgcacaggctgtgtaagggggctgggcacgcatatcccgccaacaactgcagctcccaccagcctgccaggccaggctcctggacactcccttcccgccttcctcctcccacctccctcctccctccacagtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttca

SEQ ID NO: 11900 - DNA, 714 bp, Homo sapiens
  ENST00000599703
cccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagaccc

SEQ ID NO: 11901 - DNA, 415 bp, Homo sapiens
  ENST00000595591
atatcccgccaacaactgcagctcccaccagcctgccaggccaggctcctggacactcccttcccgccttcctcctcccacctccctcctccctccacagtcctccagcttcggatccacagacggaatcaggagcagagcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcgg

SEQ ID NO: 11902 - DNA, 5014 bp, Homo sapiens
  ENST00000368468
agtgctcgcggggccgcggcggagtgtaccgtgctgctctactcgctgccattcgcccgcaggtcggcgcgctcgcccacctgagccgcgccggggctgcgggaccgtgggacagcgcgctcagcccagcctaggaaagaggcagcagtctcagcgcggagatggggagcgggcgaagttgacgagtctcccgcccacgctgcgcccctcctgcccagaggggctgcagccagcggtctgtcgcgcgtgcctgtgtgcccgaggagccgccccggggagaagacccggcgcggagttgttcccccagggaggatccgcagcccagccgagggggtcgggcggcctggctacgcaggacccagccccgcagccgcggactcccagcggcggcgaagtttggctgctgagcggcgcggcgccggaccactggacagcgggagcgatgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgcggggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataaaaagacattttatattttattctgctccattcccttcactgtataccttaataattccttttctggtaatcaggcacatgatgaactttgattagtaggtctgtgattaagttcttaaattgttttgcagtcttttatgtttattatcataggtataggtggacctaaattccttatcatatcctttattaattcagccagtgtatccaccagttttttgtttatgtttttaagtaacctattatctctggatttcatgaaggtgtaatatcgtttttgttaaactgaatagaattgtatagcgatgacctcttaattataatttgatttgactgcaaaactttttcctcctctaagaggagatgatgtctgctttaagctgtaatgttttgccatgttgcaaaaagccataataataagtataaaaaagctttttcctttacaatttcatgttaatctggtttgtctgtccaccagagacagatcttctgtgacagcctccttatgcaggtctatcattatttgatagaatgtcttctaaaatacttcactcacattgtaattcaaattagaaagtcattccaaaaggatcatgtcatgttgacctcatttcatcggaactgcagtatatttttgttggttaattatattagtgttttctattttgtaaatgtgtcctttaattttactttaaatgccctgtgtcatttctggattatatactagttaatttcttccattccccactacacagagaggtgagctttcaaattttgcagagctctgctatcactgaattacatttatctgaagaaaatagtacaacttaatggattagcttttgggtttaactgaatatatgaagaaattgggtctgtctaaagagagggtatttcatatggcttttagttcacttgtttgtatttcatcttgatttttttctttggaaaataaagcattctatttggttcagatttctcagatttgaaaaaggctctatctcagatgtagtaaattatttcctttcagtttgtgaaagcaggatttgactctgaaagaagctttgccaattttacttattcgtgatcaatcaaggaaaatctaataaattttaggccaaataagaatatagcatatttagtatggttatagtcaacacagagatcacaacttagaagaaatataaagaaatggccactccccatcccccacagtcctggagtaaatcaaaatcaatatatgattcttttaaacattaagtttgaaataggaatggttttctcaagaatagatttggtgtgataccttgtgtttgcttacattggcccactatatatacatatatatttatgtagatatacttccatgaaagggctaatacgatgcatatactgaagggcaaggactttgaccatgtcaattttcagccgagaatggtcagaaagatcagtacaaccccatggattaggctgaaacatatgaaattgctgcatttgtagtttaaaaactgtcagcagtttcatatggttccacctaatattattgaagacaattattttcttagctatcaataggcttaatagttttagttattttagcttttgaaagtgttttaaaagatttcctttatcggacaggaccatctttatgacctgctttctgtttttcaatatcatacattggtgtatgtcaaagaataaattagtaaaattagtaaatgaaaaagactcttccgtacatcattatttccatgctaatgtgtgtctgtgatccagaataacttctcccactcatatcttcagttcacctaatgaaatgaatggatagcaagagccctttgttcccaggactttaaggcaaaatattaaaaattattgccaaaattaagaatataatgtttgtataaatgtccttgaatttgccatttaaattaactcattttcttttcactttgatttgaaagctgataagtatttctgcagcagatagaatattaaaatcaggttgtgtgtacacactgcactatgaggtaccttggtgtcctggtgtgaatagacaagaagctgtactatatgttgctctctcagtggcaacaatgaagtttttgcaattctagaacttggatttttttttaacaaaagtcccaaaacaccaaaaatgtaaacaagataagagattaatattgtagtgatgtaatttaattaaagttatattttgggttaattttaacaactgaagtcttattgttgaaacttattttcaacaaaactgtgcagttaaatttgtatacgtattcacatactgaaagatgaaccgttaaaatagcacttaattttgtgtttcttcaatatgtcttgatatactttgtgcaattaatattacacatgtaagttgtatggcagtttacagaactcaatgacttgtcatgaggttttcatatgagctacacattgtgtacattgattgttttttatttttacataaatccattctgtcattttcaactttatatataaatctccaatgttatgggaaacaatagattgacacataatttttaaaaattatatttgtaaaatttctctattgtgaataaagtcttttaatata

SEQ ID NO: 11903 - DNA, 4641 bp, Homo sapiens
  ENST00000374332
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaacttcccataacccagccccctttcccaccctccctgatgccctccctgggagggggcctgaaacactggggctgttgtgcagagcaaggagctcaggtcctaacactgaagtgacagctcttcctcccctgacccttttttttttttgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgta

SEQ ID NO: 11904 - DNA, 2627 bp, Homo sapiens
  ENST00000263979
ggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagacacagcggtcctggggttgccttccagatgaagatctatcaaagatttgaagtcttgtgtatgtggtcctagaggaccccaggctgttataccgatccatgaggcatctgaccccttccaaaggatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaa

SEQ ID NO: 11905 - DNA, 3420 bp, Homo sapiens
  ENST00000473891
actaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggcaagtctcctccccacccttcttcctgcggagcagagggatgagcgtgcggctgccacagggttttcagaggcgagtgggtcctccctcatggatcagcaggagggcagtggggagcccgggagcccaagctaccactaaggtagcaaatagtagctacctataccccaacgccaggtggcagggaaggtgagcacgcagagtcaataagattctacagagggaaaaggagagacaagattctgccggggaaaaggttctcactggtctgcgtgagctcagtggcaaccacccatatgtgaaatctggagaaagtgcaactgaaatctaggcaccaccttgcattggcaggaattggccacccactgcagaagtcccctttccagagacatttagcttttccatgtgagatctgcctgccttcttccctgtgcctgtttagctcatgccatcagcaggctggcatggcaataccctgccatggcagatgccctgactgttcattcctgctgtttaaggccacatggggagcttagaacaccaatcagccctgacagctgctcatacctggccttgggcagtccccactagctagaagtgtcgctgtaggtctgacctcaaatccaaagaagggaagtgctcacacctccctcatatggcactcaggctccagcagctacagtccctccctgagggctgcctggggagatggaagccctgcccatcctctggagccctccaaggagaactctgtggcagtgccactcccaaagccttgtcttccccctggaatgcccgcctcttagaccagtatgggagctgggagatgactgatagattcccacctctatgccacggctcccagcaggcaactgggagatgatagattcccacagctaccccatggctcccagtatcatgtcgccatccagcctcaaagcattacctggcacagctgtgaggaaacagatttctgggcttcactccagggccaggcatctacatttttaatatgcattcatgtgctttttgacgcatggtttgggaccactacttactcaatgtaggagtccacctgagtgtccttaagaagctcaagaagagctgttcagcctcttcttgattactttctctgacaaggagctcactgccgccacccttaaacagtccgtcctcctggcagcccttccttcaaaagtgttttccttacattgagagggactctgcctccctgaaactcccccatttgaaagttcgtggaatgagttcaacctcacttcctggtagctcttattttctgatcctttcccacctccaagtcccatcccccaacctccctgttgccattgctcttaaatcagactcctctaggaaggttctgaccagctccgaatggagtgggacagggagctcactccagtccctggttattctggagtaatagctacccctgcctgagcacccgctatgtgctgggcactttataatggctctactcttcccaacaaccctatgaggtgggtcttcctggagttcccatatttacagaggaggaaactaagactcagagaggtcaagtcacttgccctgggccttccagctggtcagtgataaagccgtgattcaagcccaggatgtgctggctccttccagaccagattgatagagcaggctgcaggcttttgctctggagtccatccgtctatctctgtctcctctacatttacatactctggctattttcatcccccaatcatgcctcccacagaggcaattattggcagtcaacaaattggcccaaattctagaagcgcccgcaccctccaggggagctaatttggcctgcttcactgctcaccaccaggacagtcgagagtaacgcaggtacaagcacattcctgtccccgtaatggacttcgttaacataaatggatatgaaatctgacgtggcaaagccaagtgctgtcacctggaaaggaaggtctgcctgcagaaaggtggctctcccgcactcccggccccgtacacacataactctatcaacatgagacagtgtggtcccaagggcctttctctcccaaggggtcttgtgctggctaggacgtgctgagtaggatttaaccactgtcggagagcaggcactatagataaagccctcttgaattccacttctcaccttcatagccccaaaggttgcaaacccagcctctttctgctccagctggggcaggctgtgctccatggtcacggccctgatctgtgttggcccagtgctgccctgtgttgggcaggaatatgtatggtttatgttgtcagaattcattcacgtcctggctctgccacttaaggaccaggtggccatcagcaagtcaccagacctctctgagattcaggtttcttgtctgttacactgagataatcccttgtcggttatgagggttggagataatgtatataacggatctggctcaaaggaactgaaaaaggataacaactgttattgctttttataattattattatttttattaaaacactgaaacgcctgttaggacatggggttattcaggagcccaagcctctcccccgaaataattccagggcatcagataaaatagcatattactagattgggccatatgaaactgccaatattggacctttttttgattgccttatatacttaactgttttttaaatggccagaatacttaagcattctgaatacttaagttagcaacacttagcactaagcagtttttaagaatacaatacattgttatgaactacagtcatcatgtcttataccatagatctcttgaacttattcctcctaactgaaattttatatcctttgatcagcatctccccaacccttggtaaccaccattctactctctacctctacttctttttttttttttttttttttgagacggagtctctctctgtcgcccagcctggagtgcagtggc

SEQ ID NO: 11906 - DNA, 2461 bp, Homo sapiens
  ENST00000374329
gtcctttaagttgcaagggcctggggtggcaggggtagaggaatgcatgaagattcctcaccaatgcctgatactgtcagtcttcgtaacgttagcctttctagcagaaggaaactctatctatctatctatctatctatatttatttattttatttttttgagatggagtctcactcttgtcgcccagactggagtgcagtggcatagtctcggctcactgcaacttctgcctcccgggttcaagcgattctcctgcctcagcctcccgagtagctaggattacaggcgcccgcaaccacgcccagctaatttttgtatttttagtagagacagggtttcactgtgttggccaggctggtctcgaactcctgacctcaggcgatctgcctgccttggcctcccaaagtgctgggattacaggcatgagccactgagcccagctggaaacactatattcttgttgagcccctggaagtttatttatatactcattctgcatttttgttcaatccatactctgctaagcactggagaaaacagaggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaa

SEQ ID NO: 11907 - DNA, 769 bp, Homo sapiens
  ENST00000496532
accaccacctgcttggtgtctatgctttggctgatgtatcagagcccagagtgcagctagactgtgggctggcacccccaagggtggctgccagagtgagaccctcagctgtgtcttccttggacagtagaggtgacatgagaagtatgtccaagctggaagaggcctccttcagtggagcatccagttttgctccttctctttgtgtggatggaaaccaaggcctagagaggggaaggcacttgcccaaggccacacagcacagagctggccaagctggcaccactgctggtctgtccgcggggtgtggaatgaacgagggctggaaggctgagagtggagtgcagtggtgcaatcttggctcaccgcaacttctgcctcctggattcaagtgattctcccacctcagcctcccaagtagctgggactacaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcaggccttggagaaatactgtcggacagaagccggtttctctgggatccaagacgtgtacagtagcacccccaaccacgacaacaagcagcagagcttctttctagcggagacactaaa

SEQ ID NO: 11908 - DNA, 893 bp, Homo sapiens
  ENST00000475314
gaggaaacgtgtgacaagatactcctagagaacagctcttaattttctgcaggttctttttgagaaactggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggcca

SEQ ID NO: 11909 - DNA, 1145 bp, Homo sapiens
  ENST00000487493
catttccagtccccgagggtcttgttctgtccagcccaggccaagagggaagctgtgcatctgcccggtgcagccttacacagcagtccaggcaggggcaccccacacccacacacacctgacatcaccctggccgcgggttcaaggcaactgacatctctcctggatcccgaaaagcaggaggtgggaggtctgacctgggccctctgcttggctgtttccccagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcc

SEQ ID NO: 11910 - DNA, 4647 bp, Homo sapiens
  ENST00000611903
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggcaacagtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggagggtcaaggtggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaacttcccataacccagccccctttcccaccctccctgatgccctccctgggagggggcctgaaacactggggctgttgtgcagagcaaggagctcaggtcctaacactgaagtgacagctcttcctcccctgacccttttttttttttgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgt

SEQ ID NO: 11911 - DNA, 4667 bp, Homo sapiens
  ENST00000261483
ggcggggccagccgcccgctcggctcaggcgctgcgggcgcctattgacccagcggctgctgcgccgccgctgtctcctcctgctcgtggcgggcggtgctggagcgccaagtggcgctggagaaccggcgcttcctttcgccgcttccgccgccatctccgcgtttgtggggcgggaaagagggagggggctagcggctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcagggccagctctcaatgttgcaagaaaaaatagaccatttggagcgtttgctagctgagaataatgagatcatctcaaatattagagactcagtcatcaatttgagtgagtctgtggaggatggtccgaaaagttcacaaagcaatttcagccaaggtgctggctcacatcttctgccctcacaattatccctctcagttgacactgcagactgtctgtttgcttcacaaagtggaagtcacaattcagatgtgcagatgttggatgtttacagtctaatttcttttgacaatccagatggtggagtttggaagcaaggatttgacattacttatgaatctaatgaatgggacactgaaccccttcaagtctttgtggtgcctcattcccataacgacccaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaagtttaatagaaaatggtcagcttgaaattgtgacaggtggctgggttatgcctgatgaagctactccacattattttgccttaattgatcaactaattgaaggacatcagtggctggaaaataatataggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattgggatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcagggctcggatgctactagatcagtaccgaaagaagtcaaagctttttcgtaccaaagttctcctggctccactaggagatgatttccgctactgtgaatacacggaatgggatttacagtttaagaattatcagcagctttttgattatatgaattctcagtccaagtttaaagttaagatacagtttggaactttatcagatttttttgatgcgctggataaagcagatgaaactcagagagacaagggccaatcgatgttccctgttttaagtggagattttttcacttatgccgatcgagatgatcattactggagtggctattttacatccagacccttttacaaacgaatggacagaatcatggaatctcatttaagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccagactttttcattcgttaatggttttggagaagataattggaaattctgcatttcttcttattttgaaggacaaactcacatacgactcttactctcctgataccttcctggagatggatttgaaacaaaaatcacaagattctctgccacaaaaaaatataataaggctgagtgcggagccaaggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggtatggaaccacaattaaaagagacaaaagtggtgcctacctcttcttacctgatggtaatgccaagccttatgtttacacaacaccgccctttgtcagagtgacacatggaaggatttattcggaagtgacttgcttttttgaccatgttactcatagagtccgactataccacatacagggaatagaaggacagtctgtggaagtttccaatattgtggacatccgaaaagtatataaccgtgagattgcaatgaaaatttcttctgatataaaaagccaaaatagattttatactgacctaaatgggtaccagattcaacctagaatgacactgagcaaattgcctcttcaagcaaatgtctatcccatgaccacaatggcctatatccaggatgccaaacatcgtttgacactgctctctgctcagtcattaggggtttcgagtttgaatagtggtcagattgaagttatcatggatcgaagactcatgcaagatgataatcgtggccttgagcaaggtatccaggataacaagattacagctaatctatttcgaatactactagaaaaaagaagtgctgttaatacggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaa

SEQ ID NO: 11912 - DNA, 448 bp, Homo sapiens
  ENST00000502261
tttggagcttaacggcggaagtgagattccatgacttgaaccaaggcggctctagtctgagaagtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaag

SEQ ID NO: 11913 - DNA, 546 bp, Homo sapiens
  ENST00000508043
gaggaacaaggaaaaggattttagtgaaggtatcctgatcctgaaaaagtcagggagggcttcaagcccatcttggacttcagaacacctcacaactttgtggtaccttgtggtctataatcctttagaacaagaccgaatctcgttggtctcagtctatgtgagttccccgacagtgcaagtgttctctgcttcaggaaaacctgtggaagttcaagtcagcgcagtttgggatacagcaaatactatttcagaaacagcctatgagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaagcaaatgatgactaaagaagatggtaaacaccatgaagtaaatgtgcaattttcatggta

SEQ ID NO: 11914 - DNA, 2193 bp, Homo sapiens
  ENST00000513921
gaatgtttcttgacctagagtggacttaatacttcccagatttgatgagggaggtgttttcttttctgtttgaatcttttatgttttattactcgtgagtgactttgtcagcaatcctaacttagattatgaagtcctttgatcttggagtacatttaaaatatcttgttgaaattgttccctctctattcatgttattctacgagctgcattaaatttcagtgttgttggagaatattattttatatgctttatttaatctttcttttaatacaattcattcagacccgattttttatcagtatcttaatattgcagtgtccctctgctgtcttaaaattttttttttctctctccatagtctgaaatgtaatgacatctaatgttagcttctggcacgatgctagtcactttttgctagcacccttctgtgcaatgctaatctgacattctgaattttaagctgtatatctctataaatcctgtcttttcacacagatcagtagccaagccttttatctgagccttatattacaaaaaggatgcaaaatcagaagatgtcaatggagtaatcattttaagaaataagatacaaaattaaatttggttcaaatgtaactggtgatcaaaggacctttctgcataaattattttctaagttatttgtgtctgtttttactccttaggttaagattctactcagtcattgatttaattttgcatgtcatctagcatatttaatctaccaacattagtagattatttaatgtttgaacatacagaagtgttgcttttaaccatataccatagcaaaaactaaagcattttaaattatatggaataatcatatactatgtaagtgtgtgataactattcagtaacatatttaacacttctacttttggaataaaaatagtgaaacaattggcaatgatttaccaagttgaaagaaaacaatcagatgatctaggcatgccgcctatgttatttatatttaaaaattggatttattttgagagttttgttttctttaaattctgtcattgggtaacatttagttcctatcatttggtaacatggatggactttagctttgaatcagtatatgcctttatggtcttgttaaggggtataaatgaaactacaagaatatggtggatgaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaa

SEQ ID NO: 11915 - DNA, 793 bp, Homo sapiens
  ENST00000505313
ttttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtgggcaatgggcactccaatgaggcagccttgatcctccacagaaaagggtttgattgtcggttctctagcaaaggcacagggctgttttgttctactactcagggaaaggtaagttgaaaaggttatttttgcttactgttagtgtgctttgaaatcctctttctgcaaaggatcttgacaataagatcatgtttcattgcttctttactgtctcagtttcatcagtctgcaaattagtttgaatctccccatctgaaaaatgcactttctcaaaacttcagcctcctttccttgttgacatcaaaaggcatagctggaatttatgcacatttgaaggcaatgctcttgttatttcctaggccttctatttccagcct

SEQ ID NO: 11916 - DNA, 5599 bp, Homo sapiens
  ENST00000503970
ggcccagcttagtctatgagctgaatgttggttttatcccctgaattaagtttgcaatgggttttctctgtgcaactttagaatacgccagccttacttcagtaattcagcctcgaaagtgatctaatctgttttacaaagatagttacctaccacagtgcttggcacaatttcaaaaattgtaaattttcttccccacatcctcccattttatggggtccagatattactaatgcattaatgaatgtaaaagcagttcttccaaaatctgtttactctcctagagcatacagtgtgactgcttgaaggtatctgttttcctgcatgcatattcaagttaaattcacagtttccctactttgaaaaacagttttcttggaaataaaatgtctagacagactttgaaactgaaaaactgctgctttgcctcaggtatttttgcttgaaaactgatactttcatgaatatttgattttttaaaaacttggacaagatgattgctatttcagttcgtttttacaaaagtgatgtaattttagttttgagagaaagtataactttttctatcagtgaaagttaatttttatgacttttatctctatttttgtattgtcggtttaaatctcttgtagaattcaaatgtagaattccaaaggtgtttccctccccacattttttgtccccttctgttgctataaaggccttacatattcattattccaagagcaaatgtgttgcaggaattttagccatgcatgctatcaagtgatatgtaaggatggacccatgagttaaaatggacaaatgctttaggttagtagtgatatgtgcttttaaaagagcttaatgaagagggtttctaatctgttaatctgaatccagactttgttatgactttgatgtacgactctagacatataatttaggagttccctgagtctttagctacaaagttgtaatgtcaaataaaggaaatttatgctaagggcttcctgtgtgccagacatttggccagatctttgttaagctatttcatttcatttcatcttcattttatggaaaaggaaaacctggttttgctgaaacccacagctagtaaattgcagagcaaggatccagatctccagctgtctgactccccactcaggctctgaaccactcttactacacagctcgtgcactagcgcattctgccctacaaggcagtgtgaagctacttacatagtattttcaacaggttaatccacacagtgactccatgaaggaaataatacaagcattacctccattttacaggcaagaaaatagatatttaggaagaagaaattactatcctaaggtttcacagttggcacatgatagagtcctgtttcttattcttttggagatctaatgataccataaatgaagggttttcctatgtgttatttttatagtacatgggcagggtgttttaaatgtattgaaatgaattagaaatttttatcatatgatttaaaattgctgtgtgtatcatgtggtcttgtgatgactcagaattccttaaatgactcttctcttccttcaaacaaaatcttagcagtacccctacaaaatatcagtgtgaaacatcataacataggttattccagccaagactctgaggtgaggacagctttaaactgttcaggcacattaaaatcaaatcagtggtggagattctggcagctattcaggaaagatgtctctttagtacattaaaaaatcttatcccctagtgaggatgatcaggcgtttgggcatattcctgtctgtggccagagaacagaggaaagaatcagttttatcacaatgtcagtgctgagcagcacatgactcttttcaaaaactgtatgtttcttaatttttccagggatttttaattcatttatcataaacaccttccaactttaggaaacaaaatttattaagataattgtattttaaaatattcagaggcctaaaccattcatgacattgatacttaaatggatatgagaaattttattgcaagaaaaggtatactgaccctcttagctgacttgtcatgtttagtatttttatttttgcctgcctatcaacaatagcttctgcagtatcaatttaaatgatacatcaagctggtaaatgtgagctggcctaccaagtgaaagcataactaaatttaaatagctctgatataaaaataatgaatcagtacatcaaagattaagaatgcagttagcaaaaattaatgttcaataaagaagcatgtgtgacttttaagttagatggtatgtcattcaatgaccagataaggactaagttcaggtgcagtttattcaactgatgtgtgtgtttgaaaaataagacgaaaacataatgctttatttgaataaactttaataaaacaatatataatgtatggacataaggaaacctaagtcctcggggattataggggaaaccaaggcatgaggttacctaacaaggaaccttagaacataatcttacctggctcagtacaagtaggagagaatggtagcaggtgaatgggcagtgagcatggacctgaggagaaatgaatttgcctaactttcttgctaaataaatgtgcttttggatgctgacatcgagagagtggtgtgtgaagtaccataaatatttgctttattgtctgcgcggtgtgactgcattctgctcatttgcaggtgggcaatgggcactccaatgaggcagccttgatcctccacagaaaagggtttgattgtcggttctctagcaaaggcacagggctgttttgttctactactcagggaaagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagtagaaaaagaggcatattttcattacttgacaatgtgggatgggtgcaatttattccatcttcactaaaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacatattttgggaaaaaactaaaaaaagaaaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgta

SEQ ID NO: 11917 - DNA, 2870 bp, Homo sapiens
  ENST00000590474
gttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaaggacagagggttttgattttaaaaagaagaaaaaaaaaccttattttttctttcttggcctcaagttcaatatggagaggattgcttccctgaatcctctcttccttccccttttaga

SEQ ID NO: 11918 - DNA, 1542 bp, Homo sapiens
  ENST00000586641
agcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttgttagcaagcagagctatgagatcatatcattgagaattttagagaatatgataaaaattgatcttgtattggccatcacatgagagcttgttggaaaagaatcatgggtctcaagatcaaatgaattggaatttgcattttaacaagatttccgggtgattcttgtgcacatgaaagtgtgaaaaactctggtataaagtagagccctttcagacaacaggaggcaggatataatgatttatctcttcctctttccttttcttccttcttattggcctgttatctcttcaaccagccattcatccatccatccattcattcattttctatccccccattcatccatttattcatcttttaaaatcacttttaaaatgtaatagatcccctgagaggtatctgagaagaaaatatattctgattaaattatgcatcaggattcttatagggaagtaagataaatgtacaaaaaaaaaaaaaaaaaaaaaaaaaaa

SEQ ID NO: 11919 - DNA, 1851 bp, Homo sapiens
  ENST00000359094
tgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttgcaaacatctgcccaatcctgggtgatcaccacatcttttaggggaagtgacaagatgctctggtcatactctttttcccaactttggaaaacataaaaatcactcatataacagctcaaagagtaaaaca

SEQ ID NO: 11920 - DNA, 669 bp, Homo sapiens
  ENST00000589295
acatagacccacttcccttctcccttcctgaagctgcaatttcctcggaacaatgagcttgcagaggtttgctgcaatccgaacttgaggagggggtggagtctgttcagttctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctaca

SEQ ID NO: 11921 - DNA, 632 bp, Homo sapiens
  ENST00000588110
ctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaatagagacaggatttcaccgtgtcggccaggatggtctccatctcctgacctcgtgattcgcccgtctcggcctcccaaagtgctgggactacaggcatgagccaccgcgcctgggcagaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtg

SEQ ID NO: 11922 - DNA, 1512 bp, Homo sapiens
  ENST00000589647
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcagggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgag

SEQ ID NO: 11923 - DNA, 3076 bp, Homo sapiens
  ENST00000591445
aaaaaaaaaaaaaaaaagttgcaatgacaaattctcagtggggagaaagggcagatcttcctaggaaaagagagttggcattctcatcctgatgtttgccccctggactaatgaaaaacctcattcatgaccacagtctgtatttgagaagctctgtcctacctggtgcttgggttcttaacactcacagacttcctgggtaggaagtggcgctttgaatggagacatgagagctgcctgtgcaggtcagctctttcctttgccgcagtctctttctctgctatcttgctatgatttagtccttaactttttccttttgtctttccccataggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggaggtaggtgacccttcaattcaaagtccaagaggaacaataacttaaaaagaagtttctttgatcacgtaaatgccttcacaatcatggagctctttcttgtttgacacatcttgtatacgggggtttacgtgtgtgcaatgatgacatgccctggagcaaggttggattgaaattatggtattttcaaatgtggttagcctttttaagatgtggagtttctcgtctcctttcttttttgttttgtttatcttggcagaactttctatatcgcctatagactgatttgcttagatctcttataatttgaaatattctggtcttttgactgctttaggagcttcatctagcctacttgtgtactatatagacttactttgatctcttttctctacctctgttttccactttagcgttatatggattatgaggcttcacctcattaaaaccagctttttgactgactgttgctggtatttagtgtgagagatacgacatggaggaggcatctagacctaactcctagacagtggtatcagtaaaggcctggatatctggggttgtattgcttatgtctgttagtaattagattccatttttcattaaggggtaggagagcacatgcaggttctgcttggctacctactggtttgctctttgtagataaccttgcttatttgtaaattcctttatgatcttgacagaagacactgtatttccccccaaaattcaagaaagaaatagttaattcttcaggatagggtttactgttttttttttttatttttatttctccctttttcatccttttaaacaattcctgaaacaattggtctccagggtgatgtgtggatctgcatggagctcatggatacatcactagataaattctacaaacaagttattgataaaggccagacaattccagaggacatcttagggaaaatagcagtttctgtgagtacattttgatccctactgcaaggataatgtgagaaataaagtccctatgtgtctttggacctcagtatgaagaaatactacctgggccacagctactattcgtacatgtctgttgacatttattggtggatggataaatacatgctttcctttctgagcactgtgtagaagattctagcactgctttggtttggcagactctaggttaaatgactctaagtgctgcattcatcagctatgaccacattcctggtgtctatattctgacattagtttattttgattttcatttatggatttttaaaatgttctcttgagactagtaggcatagaagaaagcagaaggaaaataaatagaaagaaggtcttctaccttcatggctattcaggctcaggagggtggagagaaaaagaaggaggacaaatgaacaagacagatgagggagacatcctctctgatataagatacagtcctctctggtggatggagtccaatttgtgtaacttcctatgtattttcctagataggaccaccactatttgagaaaatatctcactggtaacctaaagccaaggataataaaccttgatatacttaacattcaatttctttccagcaatgtgataaataaatctatcttgtgtttctcttgcagattgtaaaagcattagaacatttacatagtaagctgtctgtcattcacagaggtaagcatccatgagctgccttggctgttcctttgataaagttcatctctttcacctggagtccgtctctacccccagtcccccatgggtggaagtagaattgactcaggcaagagaactaaggggctttcctttgagattggatagcaaaccatataagtagtattccttatcatggctgaggacataagaagaagacgtgatctttgtcttacatccaaattgaatataaacacttgttagcaagcagagctatgagatcatatcattgagaattttagagaatatgataaaaattgatcttgtattggccatcacatgagagcttgttggaaaagaatcatgggtctcaagatcaaatgaattggaatttgcattttaacaagatttccgggtgattcttgtgcacatgaaagtgtgaaaaactctggtataaagtagagccctttcagacaacaggaggcaggatataatgatttatctcttcctctttccttttcttccttcttattggcctgttatctcttcaaccagccattcatccatccatccattcattcattttctatccccccattcatccatttattcatcttttaaaatcacttttaaaatgtaatagatcccctgagaggtatctgagaagaaaatatattctgattaaattatgcatcaggattcttatagggaagtaagataaatgtacaaaaaaaaaaaaaaaaaaaa

SEQ ID NO: 11924 - DNA, 431 bp, Homo sapiens
  ENST00000592348
aaaatatatatggcttctagattttaatgattatttttttttctttaagcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgt

SEQ ID NO: 11925 - DNA, 1509 bp, Homo sapiens
  ENST00000613873
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatg

SEQ ID NO: 11926 - DNA, 2111 bp, Homo sapiens
  ENST00000318631
cgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcacgctt

SEQ ID NO: 11927 - DNA, 890 bp, Homo sapiens
  ENST00000431348
cgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatca

SEQ ID NO: 11928 - DNA, 549 bp, Homo sapiens
  ENST00000445426
gtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagct

SEQ ID NO: 11929 - DNA, 360 bp, Homo sapiens
  ENST00000463801
ctgcgcccggcgcccgcggggtctacgtgctgcccatcggcgacgcggacgcggctgcagcagtgaccacgtcgtacaggaatagcaagagcttggctgcctggacccctgcccccaattcgggcagaaacacaggatcactgttgaacttgaccctcccagcgccatgccagtgggcctctgggacccccaccttccagctctgggacctgatacaagccactccctccagccttgtcttgtaagatgtacatcatctaagcaaacttaagaaattcagaaagccaaggaaacgaacagagccaggaatcctgaagatgtgaggccactcctaactcaaggttcttgagggagtaccca

SEQ ID NO: 11930 - DNA, 4152 bp, Homo sapiens
  ENST00000354570
gggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagtt

SEQ ID NO: 11931 - DNA, 3119 bp, Homo sapiens
  ENST00000454590
atatcatattttcccctctctgctgtgggctgaatattttactgtgtggtagcaggaagaagattggaaaaaggtgctgcagcaggaagaagctgggatctgattgaacagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttata

SEQ ID NO: 11932 - DNA, 2744 bp, Homo sapiens
  ENST00000544465
gatatttggtctttgcctggctgagggacacaaagcaagaagagggagacatgcagatatgttgcaggatattcaagaaagaaggattttagcatggaagacactaaactgtactcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagag

SEQ ID NO: 11933 - DNA, 2633 bp, Homo sapiens
  ENST00000438100
aaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagta

SEQ ID NO: 11934 - DNA, 2317 bp, Homo sapiens
  ENST00000611373
atcctgctgcgctgccgctgagaggaagagggagctgcccagcggcctcacgctgtaaccctctgctgctcttctattccatctaaggaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttacctttt

SEQ ID NO: 11935 - DNA, 4326 bp, Homo sapiens
  ENST00000616617
gggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 11936 - DNA, 4375 bp, Homo sapiens
  ENST00000432797
gtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 11937 - DNA, 4536 bp, Homo sapiens
  ENST00000617204
agtgggagggggctggtaggggaggtggggaagctgctgctaggtgaggggaactgcagggcctcagttgccaagtggctggtactatctgtcagctgtttgcaaactgtttacccataggggatctattacaagtgctcaaatgaacaggcagcttaggaactagcagcttcctgggagctgcaattacataagcatatatttttaatataatcacaattaaaaaaaaaaaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 11938 - DNA, 4497 bp, Homo sapiens
  ENST00000618822
gggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaactttagtcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggct

SEQ ID NO: 11939 - DNA, 6248 bp, Homo sapiens
  ENST00000497036
ggaaggcgccgcggcctcggcttggttcagctgggctgggttcccccacccggcaacccctcctccaggcagcctgctgtggggccgggcgggggtcgggccgtgggtccccaggggagaaggagagcaaggcctgtctctccttgggagacgactcccccaagggccgttccccatcctccgccagccccgggaaggactcagccccttgactcggcgcctcagccaggccctggtcagggaacacgacttggccaggcccaggggatcctccaggtctcacgccaagccttgcccccagccaggaagcccgcggtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccctgttctggctgtgcgtcctcatgccgggtcccaccttaagacctccgggcccttggcctgcatgtagaggaggctggcctgatagctcagacccttagagccaggaggggggcctgagcatcccatctctcccaggccacaaagctggtgcccacttcccccaggcctgtgccagtgatcttcgaacccccacgttagggcttggcccctccccttttacggggtgacctgctaatggcttagactctaagccactgtgtgtggatcctgaagccagacccaggggcagggcctgatggggaggagtgttaggatctaccctagctctctgcatcctccaatgccagcaggtccctggggggagggggcacgctgggcacgttgagacccctgtggtgaagtggtgagcgccagccagtccctggggggacggggcacattggacatgttgagacccctctggcccctgtggtggattggtgagcgcagagggctgggttttattcttgatcaaacctctagcccctactaccctgctccagtggtatcttcgtgcccaggccgccctctgcaggccactcggtgtttccaagggtggcggctggaacacaggccatgggcacctccaaacctgtcccagggcaggggttacagcagagagaccagtgaggggcagggcagggcaggccaggtgtcctcggtggacatgcccacagctggcccagccaaagtggacctgatgagctgccacgacagatgggccttctctgcccagcgaccctcatgcctctccagggcatccgggcctgggggacgtgatcgccatcagttccggagccacgctgacttgtggcatggctgctgtccacactgggcccaaagtgtgggcccataggtggcctgaggactgggggccccaaaattctgtgacccagctggatgtgaactcccgcgggggcagggtgtcccctgggctccagggggcctcaggtttcctctcgggcatcttcctccgtggctgtgcccgtgcctcctatcttcctcagtcccccaccatgctaccgcaaccccggtccagtgtccccacctccaccgaccttgactctgctcttgggccaggggtcttcttggagctagaaccggactcactccctccttaaacctcgggggcggtgctgcgcctccatgcagccacgaccaccgccctgagccggccgcagcgccacctgcctccccgcgggctcctcccgcctcgtggcctttgccctgcagacccctcgcccccctcgcctttcaccccaggtcttcctgcgcccgggccgggtgggccttggggctgcgctggaccctgacccagctggtgcagaacggggctctcatgggcaggctcggccacgggcgttcgggtggggctgcggcgaccactcgcctaaggccgggggaccccgcccctcttggaggggatcggggcggggccaatggggaggcggagccgcagcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgagtaagtgggacctggccgaggtggggtgcggggagggacctctgaactgagctcctcatctgccccagccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacaggtcaggacgggggcaggccccacgatggggggcggggcgggcagcccagctagaaacctaagaacctgggcctaccccgagcctgccagcctcgaatacagagcctctccctatgcacctcgggtgggctcacaggcttgaggaagtgacagggtggccactcccaccatgaatcccaggtccccgcctcccgcccccctgctcctgctggtgaccctgcctctcctgcctgcccatctgcatgcagcccagagtatgtatccctggtcagggagacccaggtcctaggcaaggaggagctgcaggcgctgtccggacagttcgacgccatctacttccacccggtgcgtgtccccggacacactcacctgtgcagacacacatgcacgtgcctttgagcgttcacagccacggccgccaaccccagccagtgtcccctggtccatacacatgacattgccctgcacacctgcctgctggcactgccagagcctggggctggcctgttctgctcagcagctggtgtcttgcagcctggcacaagtgtgggtatggcctgcaaagggcagcagggaaggcagggggctcatctgcgcccctgcgcccacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggtgcccaccctcaagccccaggtccccacccagccccctccccctgggcccctcccctcccccacagttcaccctcaagccccaggtccccacccaccccctcccccgggcccctcccctgccccacagttcaggatgtagcctgggatgtcctgccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgcccc

SEQ ID NO: 11940 - DNA, 1459 bp, Homo sapiens
  ENST00000395780
tccgccccgcagctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgagggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 11941 - DNA, 1785 bp, Homo sapiens
  ENST00000488504
gcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagtgagtcccggtggagaagccgctcatcagccctcccccagtgcaatccccccgcctccacgtcccacctgtgaggatgtgatggggtctgggtgctgagccacgccctatgcacagcccctggtgggaacctgcctgggtgcccaggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 11942 - DNA, 1918 bp, Homo sapiens
  ENST00000215659
cggcggcggccgcctcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 11943 - DNA, 2019 bp, Homo sapiens
  ENST00000467891
cggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtggtgagcgcgggccgggcggggcggccggcggggcgggcggggcctgcgcggggtgcccggccttcccgctaagcggtccgccccgcagctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagtgagtcccggtggagaagccgctcatcagccctcccccagtgcaatccccccgcctccacgtcccacctgtgaggatgtgatggggtctgggtgctgagccacgccctatgcacagcccctggtgggaacctgcctgggtgcccaggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatag

SEQ ID NO: 11944 - DNA, 2763 bp, Homo sapiens
  ENST00000496942
tgtaccagatgctgaaggggctgagggtacgggccccgggggaggctgcagggaggcaggcagggcctcggggctgggcagaggagggccctgtggctctgagagggtgcgctgaagcctgccaaatcctctgccccccgcagtatatccacgctgccggcatcatccacagagtgagtcccggtggagaagccgctcatcagccctcccccagtgcaatccccccgcctccacgtcccacctgtgaggatgtgatggggtctgggtgctgagccacgccctatgcacagcccctggtgggaacctgcctgggtgcccaggtaccttggtctgcccttgaagggctgcagagagcaagggggccaggtccggtggccccatctttaggtgccacccaggctcttggctgtgcccatgcttgggagggtggggcacagtggccacctttcctctgcccccaggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacgggtgagaagctgcccagagatctgggcctctcaggctgcaccatctgcttctccacttcttcacggacagccctgtggtggctgctcccagggaggctgttgagctggggtgggagccgggcaggtgggctgtgttggtgtctcctccctccccgtctcatcctgtccccctgcccacggagctgaccagggcttctatctcagtggacatctggtctgtgggctgcatcatggcggagatgatcacaggcaagacgctgttcaagggcagcgaccgtatcctccagccgcagggcggcaccaggggcgggtggggatggctcctgcccaggtgggggcagtgggggccctgatctctggcccccgagctgtgttcctgacctcggtgcagacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacctgtgagttgggggctccgggtagggcctgtgtggacccgtgagttgggggctccgggtagggcctgtgtggaccctgtgggccctgtgcaggtggccaggctcagagtcctagatccccatccctgggatgcaggtcaggtgaggaggatgggaggtcagggcagcatggggccgtgtggcctggtggagatgacctctggctggagctggaagttgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggccaccctgacaccctcaccacgtccgcttgtccctaaggcctctctgctcacacctcctgaatctgtccttgcctctccttgccccatttttgttttttgagacggagtctcactctgatgcccaggctggagggcagtggcacgatcttgactcactgcaagctccgtctcccgggtacacaccgttctcctgcctcagcctcccgagtagccgggactacaggcgcccgccaccaggcctggctaattttttgtatttttagtagagacggggtttcaccgtgttagccaggatggtctcgatctcctgacctcgtgatccgcccgcctcggcctcccaaagtgctgggattacaggcgtgagccaccgcgcccagccctctccttgccccactttaggatccctcccccctggacaactgtatacccaagacagtccccagggcctcgcctgtctcccccagcccccgctaagcagtccagactccaaccccaactgctggggtccatcatcccctataccaggggctatcccctcaacttggagggctggccaaagcctgtgcagcctcaggctggactcagagaagcctccccagctcccgcagctatgctgcggcctgaggctgtgctggacctggcttcatttctgctccaggatggcaggctgtgtcttcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataacttgaaa

SEQ ID NO: 11945 - DNA, 2101 bp, Homo sapiens
  ENST00000482969
ccgagctgttcgccaagcgcgcctaccgcgagctgcgcctgctcaagcacatgcgccacgagaacgtgatcgggctgctggacgtattcactcctgatgagaccctggatgacttcacggacttgacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacctgtgagttgggggctccgggtagggcctgtgtggacccgtgagttgggggctccgggtagggcctgtgtggaccctgtgggccctgtgcaggtggccaggctcagagtcctagatccccatccctgggatgcaggtcaggtgaggaggatgggaggtcagggcagcatggggccgtgtggcctggtggagatgacctctggctggagctggaagttgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggccaccctgacaccctcaccacgtccgcttgtccctaaggcctctctgctcacacctcctgaatctgtccttgcctctccttgccccatttttgttttttgagacggagtctcactctgatgcccaggctggagggcagtggcacgatcttgactcactgcaagctccgtctcccgggtacacaccgttctcctgcctcagcctcccgagtagccgggactacaggcgcccgccaccaggcctggctaattttttgtatttttagtagagacggggtttcaccgtgttagccaggatggtctcgatctcctgacctcgtgatccgcccgcctcggcctcccaaagtgctgggattacaggcgtgagccaccgcgcccagccctctccttgccccactttaggatccctcccccctggacaactgtatacccaagacagtccccagggcctcgcctgtctcccccagcccccgctaagcagtccagactccaaccccaactgctggggtccatcatcccctataccaggggctatcccctcaacttggagggctggccaaagcctgtgcagcctcaggctggactcagagaagcctccccagctcccgcagctatgctgcggcctgaggctgtgctggacctggcttcatttctgctccaggatggcaggctgtgtcttcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtgtgcatattcgtgtgcttatgagtttggctttgtttgattaaaggtttctgctgctagaaagataa

SEQ ID NO: 11946 - DNA, 2021 bp, Homo sapiens
  ENST00000497738
ggtacgtggtgacccggtggtaccgggctcccgaggtcatcttgaattggatgcgctacacgcagacgggtgagaagctgcccagagatctgggcctctcaggctgcaccatctgcttctccacttcttcacggacagccctgtggtggctgctcccagggaggctgttgagctggggtgggagccgggcaggtgggctgtgttggtgtctcctccctccccgtctcatcctgtccccctgcccacggagctgaccagggcttctatctcagtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgagtggggggctcctggcacggcctgtgtggacccaagtggggggctctgggcagggcctgtgtggacctgtgagttgggggctccgggtagggcctgtgtggacccgtgagttgggggctccgggtagggcctgtgtggaccctgtgggccctgtgcaggtggccaggctcagagtcctagatccccatccctgggatgcaggtcaggtgaggaggatgggaggtcagggcagcatggggccgtgtggcctggtggagatgacctctggctggagctggaagttgaagggaagggtgttcctggcaggctcagcacagaggctggcacagaaggagccgggagtggtgaaaggcagctgtgagtcagggaaccagggcccacttagcccctcctggcccccagacctgctgcccttccgccatgtccaggccagagacctgggccaccctgacaccctcaccacgtccgcttgtccctaaggcctctctgctcacacctcctgaatctgtccttgcctctccttgccccatttttgttttttgagacggagtctcactctgatgcccaggctggagggcagtggcacgatcttgactcactgcaagctccgtctcccgggtacacaccgttctcctgcctcagcctcccgagtagccgggactacaggcgcccgccaccaggcctggctaattttttgtatttttagtagagacggggtttcaccgtgttagccaggatggtctcgatctcctgacctcgtgatccgcccgcctcggcctcccaaagtgctgggattacaggcgtgagccaccgcgcccagccctctccttgccccactttaggatccctcccccctggacaactgtatacccaagacagtccccagggcctcgcctgtctcccccagcccccgctaagcagtccagactccaaccccaactgctggggtccatcatcccctataccaggggctatcccctcaacttggagggctggccaaagcctgtgcagcctcaggctggactcagagaagcctccccagctcccgcagctatgctgcggcctgaggctgtgctggacctggcttcatttctgctccaggatggcaggctgtgtcttcttcatggctgcatgaccagcctggggtgggtgtgcccggggaaagtaggtgtacactgggagccgtgccatgtttcaggccctgtcctggctctgcctcgggtgcgggaccttggtcctccacactggctgggtggggctggatgggttgagattcacatgtgctccttacgaccacgggtccctgggtgcccgcagcagggcctccacccttcgctgtg

SEQ ID NO: 11947 - DNA, 498 bp, Homo sapiens
  ENST00000492218
aacgtgagtcgcgcggccccgctccgggaaggcgccgcggcctcggcttggttcagctgggctgggttcccccacccggcaacccctcctccaggcagcctgctgtggggccgggcgggggtcgggccgtgggtccccaggggagaaggagagcaaggcctgtctctccttgggagacgactcccccaagggccgttccccatcctccgccagccccgggaaggactcagccccttgactcggcgcctcagccaggccctggtcagggaacacgacttggccaggcccaggggatcctccaggtctcacgccaagccttgcccccagccaggaagcccgcggtgatcgggctgctggacgtattcactcctgatgagaccctggatgacttcacggacttccgacccctctgacccagatgccttgccgcgcccccatcgcccccaggcacctccctcatttctggcacaaagttgtgaagttgaaacctgactgcct

SEQ ID NO: 11948 - DNA, 605 bp, Homo sapiens
  ENST00000395778
aggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttgaaggtcccgtgctcgggaccctggcaccaagtgtgtggccggtaactggagctgctgaccttttccagcgggtgggggagaagcggtagggaggacccaccctgcccctgccctgcagccgaccaccctgggactcacaccctgtcggccaagagtgaagggccaggccgaggaaggcctggagagggtagcaggcgcctcccgcctgacttgcagaggtcaagtcagtggcctctgggaaggtgctaaataccat

SEQ ID NO: 11949 - DNA, 1779 bp, Homo sapiens
  ENST00000622558
gcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgagggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 11950 - DNA, 848 bp, Homo sapiens
  ENST00000587823
gcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaaggcccgctaatgagttcttcgttgtttgtgttgagaagaggcagctgaaggattggagtgtgctttcttctgaatttatcccattaggaagcagactatctcaaaagagaaaaaaaatgtcattaagacttcactgagcactgtgtaaggcttaagaaaggtcaggaaccacctcaagagtatgcggaggtcctgaggagcacgatgacagcttgactcacggtgagagtgtgttgctccaggaagggccacctctcctcctaccatagagtcctcgctggggctgctggggggaccacccactacccttgcttgtagcacttattttaccctgggctcactaaacctgctcatctccactacaacattcaagaaccgtcaaactcctgatccagtaaccttctatgactagcgtgcatcatggcatttacagtaaagctagccctctacagctcacacctctgactgccaaaggcacatatagaggccccattgccgggtctatcgttcttgcagcagtacttctaaaattaggtgggtatggtataatacaagttactttaattctaatcccctggcagaatttatagcatatccattcctcattctatctctctaagggataatcataacaagttctatt

SEQ ID NO: 11951 - DNA, 3144 bp, Homo sapiens
  ENST00000588540
gagttcagattcggatcgcagtcccgattatcctcccctccagcctctccctttctcgttgaagggttaatacagcgtcctctcccctcgccacccgacagaggcgcctacactggcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagtctactgattgcatcacaagcattgtgggtcacattccagagccttctgagaagggagaagtcagggaagttccttttgttcttctgagcgttctctgcaagtcaaactggggagagttccagtcctgtggggtgggagcagctgtgaagaggctggaatcggagggaactttggggcctggaggcctaatggaggactctgtgatgttggactatgttgtgtcgttaccctccctgcctctgcatcctcttctgtggagcagggacaatgacagcagccatcctgggagagcatcatgatgaccaaatggaaggaaacagagggtgaggagcaccccaagcacatggtcagcacctggcaggtggctgttattattacccactcctcaaaagtgcttttggactcacattttctttctttctttttgagggtggaggtgtagagaggtgaaataaagctctgagtctgacctccaggttggtcccaggcaagattagcagcctgaggggtccggcttccacacggtagcatgaatagcatgttcaatagaaaaccggacccataccccacacggcagagggctaggcttgagcacagacactacctttgtcctgagatttctacatggcaatgaaacttcgagctaattttctcctgactggtggtcagttcctgaatttcatgggcatatcaatcattcctttagctcaacgtttttactccattcattcacccgattgtaagtgagcgcctatcttgtacagaggtgcactgcagacagagggaaaacaactggctcttgccttcaggagccctcgctgcctcccctgctatagagttaatgaagttagatgaaggggtccaggaggctgtgtgaacacaaagccttgccagctaagtcagagaggagggtcctgcagtaatatccccaaatgtaaaatgaaaaataaataccttcaacagggttctcaggaggtgagctgagctactgctggcaaaatcccttgtacagagtggatgtcaacaaatattccctcccctccctaatgtgctctcagttatgtacctggatgttaataagggagctgagagaaaagtttgctaggagggcggagaaagtttccaccctcctcgggggaagaggtcggggacagaaaggggaggcctggggctcagagaccaacgtctcatgtcttctaccacatggccacgtggctcgccccttgactcactctggtctctgctcgaatgtccccttacatgagaggcctttctggaccacccaccccatcactctctatctccttaccctgctttatttccattccttgcacttatctccactagacatatcatccatttgtttgttcagctgtctttccatccaaagtgtgcacctcatgattacagggactttgttttgctcactgctgggatcagatctcagctctgccaattattagttaatttgatcttgctcaagttagccccatctctctacctgtttcacagggtcattttgataattaaatgcactattaataaagcagtacttggcacggtgcctggcacatcataatttctcaataaacgatagctattattatga

SEQ ID NO: 11952 - DNA, 572 bp, Homo sapiens
  ENST00000586735
acttgctacttgcacagacttgtctctggtcctcaagtttggccaacagtggagcactctgtgggagaggaagtcagagagttggaggcaggtccaggaacataatttgcagggcacaagtgcaagatgaaaattcatgctccttgttcacaaatgatgaagaaattcaagacagcgacagcagagcatcagctaaatgcatggtccttttgagcttcgtggggcactgtgaccccatgggccatccgtctttgaggctggaccatgttggaaaccactggagaaggcagggggttgggggttgagcctggggctcagaggttctgtgttaaccaaatgccactcagctggaagatcagcgatggaaatcagttaacatttaagaaatcacctggaggcccaggctctgttccaagccattagggattcggcagtgagcaagcaagggctgctgtgagtagggaaggagacttggtctgaaagatgccacattcctgcagcctctcttggtgcagtggaatacagtcttgggcgaggtggcgtggatgagctggtgaaagaggatgctgccc

SEQ ID NO: 11953 - DNA, 1576 bp, Homo sapiens
  ENST00000540640
gagctcgccgtgcgccgtggctgggaccggcctggccgagcgcgccggcgccgcggccgcagacaaagggcggctcgcgcccgggccgccacgctctcgggctctgcctcgggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagac

SEQ ID NO: 11954 - DNA, 4330 bp, Homo sapiens
  ENST00000592595
gtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacaca

SEQ ID NO: 11955 - DNA, 4770 bp, Homo sapiens
  ENST00000400384
gcgggagccggagcccgagctggagcagcgagccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcgggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacaca

SEQ ID NO: 11956 - DNA, 166 bp, Homo sapiens
  ENST00000632577
gcgggagccggagcccgagctggagcagcgagccgggctgtcggggcgaccgcgggagctcgccgtgcgccgtggctgggaccggcctggccgagcgcgccggcgccgcggccgcagacaaagggcggctcgcgcccgggccgccacgctctcgggctctgcctcg

SEQ ID NO: 11957 - DNA, 111 bp, Homo sapiens
  ENST00000632712
gagctcgccgtgcgccgtggctgggaccggcctggccgagcgcgccggcgccgcggccgcagacaaagggcggctcgcgcccgggccgccacgctctcgggctctgcctcg

SEQ ID NO: 11958 - DNA, 102 bp, Homo sapiens
  ENST00000631501
gtgcgccgtggctgggaccggcctggccgagcgcgccggcgccgcggccgcagacaaagggcggctcgcgcccgggccgccacgctctcgggctctgcctcg

SEQ ID NO: 11959 - DNA, 118 bp, Homo sapiens
  ENST00000631637
gagttcagattcggatcgcagtcccgattatcctcccctccagcctctccctttctcgttgaagggttaatacagcgtcctctcccctcgccacccgacagaggcgcctacactggcg

SEQ ID NO: 11960 - DNA, 803 bp, Homo sapiens
  ENST00000591734
ctctcgggtggactcccggagcggcggcggcggcggcggtggcagactgcgagtcacgtgcgacagaggaggcggagcacggcggccgggtgggtggagaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgat

SEQ ID NO: 11961 - DNA, 553 bp, Homo sapiens
  ENST00000589180
agaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatggtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttctt

SEQ ID NO: 11962 - DNA, 348 bp, Homo sapiens
  ENST00000590793
gaaggaggcgacagcgccggagcagaatgagctgcaatttatagactgaaaagacaaagggattcctttttcaccaaatcaaaaaacacattataattaacggctgcagttgactattataggatgtggtttcctgcaacatgcctgattttgaagaagggtgatctacacactgggaatgaagccacagagcatgtatgttacatgtagctgctggctatatatgtccacgtcagccacacactcccttctgctcctcagaaccttaaagttctcctcatggctggggaacagtgatgtgctccagggctccaagcaatggattcctcagcagacattgctctgtga

SEQ ID NO: 11963 - DNA, 584 bp, Homo sapiens
  ENST00000587359
gaaggaggcgacagcgccggagcagggctgcagttgactattataggatgtggtttcctgcaacatgcctgattttgaagaagggtgatctacacactgggaatgaagccacagagcatgtatgttacatgtagctgctggctatatatgtccacgtcagccacacactcccttctgctcctcagaaccttaaagttctcctcatggctggggaacagtgatgtgctccagggctccaagcaatggattcctcagcagacattgctctgtgaaatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctg

SEQ ID NO: 11964 - DNA, 4323 bp, Homo sapiens
  ENST00000436190
gtagacccgctaggcaggaagaggtcactaaaaatactatcgtgctgtcaatgtagaatgaagggttaagcgctcaaacccgcgcccgcgcgcaccgaaacggaagaacttccttgattagcatagtatcgaccctggggccgcgctgcgaggcggaggttcggtcccagctggggtgaagtgtgcagaccggttgcgattgtggtcagacgcagcacctacttctaatctgaggacccgcgatttacacttttgctgaataggacactgtggaatgaaacagaacagagatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 11965 - DNA, 543 bp, Homo sapiens
  ENST00000588349
gtgcagaccggttgcgattgtggtcagacgcagcacctacttctaatctgaggacccgcgatttacacttttgctgaataggacactgtggaatgaaacagaacagagatcaaaagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgta

SEQ ID NO: 11966 - DNA, 4265 bp, Homo sapiens
  ENST00000300249
gtcagctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 11967 - DNA, 4093 bp, Homo sapiens
  ENST00000538170
gagagctgggagaaggcagtgagcgagcaggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 11968 - DNA, 1389 bp, Homo sapiens
  ENST00000588910
caggcggcaggcacggtccgtgcggagcaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtaatgcatcagctctggccacgcctctaggagcagtgacgtgtgtaagaggtagggggcctaggatcccctaggactggggtaagggagggaagggtaaggaagaatccttggtttcaagtaagtgagaataaaaagaattgttcgaagacaaaatcagtagcccatgatgaataaaaagtgttagtcacaaatctcaaagctgtacattaagatggggcagatggctcagccttgctgcagacttcaggctaccttcccctcccctgctcctcagggccgtcaagagctccaggctagaccgttgcccatcctgcccacttctggccattctagatagtgctgcattagggtgagtctgcctccctctctttttaaaggctgggtcagggttagtctgtctccctcccactctcttcttttttcccttcttcctttctttcttcagctattagtagttgagcttattctatatgaaagatattacgcttaatgctggtaatataaaggtagtaaaatagatacctttc

SEQ ID NO: 11969 - DNA, 622 bp, Homo sapiens
  ENST00000585592
cctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggtaagacatattcttttaagtgtttacctaaatatttacagtctgtcatgtggaatgtgattttatgaaccacagctgctatattttgggtaggaaaaagtatatattgctattggcatgtaattaaagggggaaaaactcagatataactaaaggacgtattgggaaaagtgtttatgagcatccaggagcacaagcagagccacacggacacgtattggaaaggtctcttgcttgagcttcgtaatgcctttcactggctcctagcctcttctctgtcatcccatctgccatcacacttgcctcctgaaaacaccaattg

SEQ ID NO: 11970 - DNA, 4080 bp, Homo sapiens
  ENST00000589699
gcgttcctacaggtaatggggctggcacgagagcagcgccggggaccgccgtgagggcgcgcggaaatccagcccgttatataatggagcagacactgcctgcgacccctgctgcagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgttaaaa

SEQ ID NO: 11971 - DNA, 476 bp, Homo sapiens
  ENST00000588085
gttatttctgcttctctctctctctctcttttgggttttattcacaggaattgctggtcatgtcttatactatattttgggtggttttttttcttcactctcactcccttgcaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactg

SEQ ID NO: 11972 - DNA, 4173 bp, Homo sapiens
  ENST00000413393
ctctcgggtggactcccggagcggcggcggcggcggcggtggcagactgcgagtcacgtgcgacagaggaggcggagcacggcggccgggtgggtggagaaaacaaagcccccagctgtcagcagaggaaggaggcgacagcgccggagcagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgccaaggtgtattagcggacggccctctggccacctacccgagagatcgtagggtcacatacatccaacttcaccacttggctgcttgagattggttctgctcttttcttcatttctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttctgaattatgtatcctgaagctttgaaatttctttattaatcgatgaaatatgaattctaaattctagcattgaagcttttcaccaaaagaagtctctccaaaataaatcttttgcagcaaagtgatatttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacgtgagtgggtagcagggagtcaggatcctgccttctccagcaaccccttactgctgtataacttgcataagcctccctggtgactcttgcaggaaccactccattgccctccagctccccagccttctcagttataaacatgctggccagatctcttagcctgcaaagagaactttccccagtcaccatagaccattctccttcctgaaggcttggggcagaccattcgtttatttagagaagagctatacattcttctttctggtcccatcttaaacgtcttctgttgtgctgcaccccagatggtgtctcagatgctttggggaatctttaacagctgaatttgagtcagtcctcttaggctgcacctccagcctctgcagatcccccctcatttcccatggatggtgggaccccattattctctcatctcggcattcagggaacagtttccttagcggcccctggtcacatgtcatcgggctgggcaggaagcgtccctgattgcgtgctccacttctccctctcaggaagcccagtttcatccttagtaccccccctcgtgcccgctgtcggctggttatagcacttccactgctactgtcagataggaagtgatcgaagcagggggcaaagagaaagcccatatttgttctaagcagaaaagcaggaaaaaaaaaaaaaaaaaagaaagaaaaacacctgttgacctgagagaagtaaattccagaagggaaccaagaactcttcccttccctggtgagtatttccattattccgttaaggtttaatatgcattcagattacttttactaaataggacaccataaagcttttgttatatattaaatgtaaactgaaaggaatgtaaacatatgtattgttaattataaatatagataagtaatgacataatagatgaaaaagtcttattcagatgtatcacattcattttacattacccacctattgtcgcatggtagaatagttttttgtctctgaatatgtgaataacttgacttgcattgatctttttacatatttaataaaaaaaaaagtatatgtt

SEQ ID NO: 11973 - DNA, 758 bp, Homo sapiens
  ENST00000469583
gaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacagaatgtgtgcatgaagaggaaaggctgtttgggaggtttcctgatgtaggacccccgcatgccgcggttttggctggtgattaaggaagatggacacatggtcactgcccgacaggagcctcgcctcgtgctcatctccatcatttatgagaataactgcctgatcttcagggctccaga

SEQ ID NO: 11974 - DNA, 1335 bp, Homo sapiens
  ENST00000359316
cgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaa

SEQ ID NO: 11975 - DNA, 2134 bp, Homo sapiens
  ENST00000366913
ggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaatgtttttaaaatgtgtgccttttattacctatcagtctatgttttgggagaaatgggaagcaacagatcactgtgtcctgatgtgcaggacgcatgttaccacactcacaaatgcctaatattggtctttatgtggccattgagtcctgttgactttccactcatgtgctttttactctagcattatggaatctgggctgtacttgagtatggaaattctcttatagacttagttttagtactctattacacctttactaagccacataaaagtaatctgtttgtgtgtaactgccagatataccacctggaattccaagtaagataaggaagaggatgacatttaaaagagaatggaattttgagagtaggaatgcaaggaagacagcatgaacatatttttttcagtgcaaataattttttcgtaacaaagaaacgaacaactttggtatgatcttaagcaaaaatactcactgaaatagtatgtggatgaattcacctacttacaattttatggtttctttgtaaataataaatgtgaatctcaatcctgcttta

SEQ ID NO: 11976 - DNA, 585 bp, Homo sapiens
  ENST00000425560
ggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtaaggagcctagctagaccccaggactgtggtgtggcccattcattggttcctaagcatcacctaaccc

SEQ ID NO: 11977 - DNA, 252 bp, Homo sapiens
  ENST00000496078
ccagggctcagaggggagcctcagattactccgtgaactctcatcttacgctttttcaagcaaagcgtctaagctgaaatccacaactcatggttcccaattttcaaaagtctgaagcaataattcactgaattcagtatttcaggatatttggccttgacattaaaggcagagactgtggcaatgaggcagctaagtggttcaccaacttcttgaaaactgaagcgtatagattggttcaatttgagacaa

SEQ ID NO: 11978 - DNA, 699 bp, Homo sapiens
  ENST00000472447
agactcaaaggctaatgaagccaccatttaaaagataactttctcttttctcttaggatacctgggatgaactcctaattggtagtgtagaagtgaaaaaggtaatggcatgccccaggtaaggagcctagctagaccccaggactgtggtgtggcccattcattggttcctaagcatcacctaacccttggttactgcataacaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctat

SEQ ID NO: 11979 - DNA, 5877 bp, Homo sapiens
  ENST00000503008
agaggaggggagaggactggggagccgagccagagccgggctgcctgccacccggctgctcgtccgctagctggggaggagcgctccacccgcaactgacaaaggatgggagaatgcccgcgccccgggatgccggccgcacgcagcctggcggccgcctgagctacttcaccctccgccggtaagtgactgcaaacatcattcattcaatcagcctcactgggagccccttctctccggctggtagtcctgggcggcttgtccctgatcccgagcggggcttggcacagcatcagccctggagggcaggcagcaggtgcctttgcctggtgggtccactggggagcgtggctggggttcgcggcgggtgctgccacccaacctgcgggcggcgggctcgcccagtaggcgcctctctggtgagaggaggcggctccagcccgcagcctggggtagttgctactattggcccccagcgcccgctctgcgcgcgcgccgtttctggcggatccccagtgcgcggcgcgctgtttacaccggcgtggtactagtcacggagccgcacccctcggaaagcgcggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacgggaaatgtaccccaaaagaactctgagagaatatactcaactgtcctgctgtgattaaacaagactgctgtattttaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaacctta

SEQ ID NO: 11980 - DNA, 3903 bp, Homo sapiens
  ENST00000514618
actggggagccgagccagagccgggctgcctgccacccggctgctcgtccgctagctggggaggagcgctccacccgcaactgacaaaggatgggagaatgcccgcgccccgggatgccggccgcacgcagcctggcggccgcctgagctacttcaccctccgccggaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatgggagaaattcaatgggcagaaacaaagagaagaacaaggaagtcgagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagatctgccatcttgcatgacatgtcagaagagtcatttgagtattgcacccctgtcatggtgctgagccctgctaggaaggagtctggtaagaaatcagtaatacaaagacctaggaggaggagaaaagcctctgagagatatgagcatgctgcagaagaacaaataagagggagaaaaaatgactttcaccttcaaatctcaagccccaggtggagggagctttacacagattcttcagattcatcttccacagatgagagtcattggattcaggcaaaaagaagagcccaggttaaattcagactgtcaagaagaaggaggagaaataataataagccgtgtgaaaacttagctgggtcttccactcctaacggaattgagctcgttgatctgggatccaaaggtaaagagcaacaagagctgattgaatgtgagagttgctctttaaatctccacagaggaaaacatacaaggtaccaagaatgcaacccttctctgactcaagggtcctctgaaattaagagatcctcaaggaatcatgagaagagcaaaggcagatatcaccacagagatcctcagctcttgcaaagtcttaggaaaaatgaaataatgaagaagacattttcagaaacagattccagcactgaaatactgggagttccagaaggcagcaaggacatgaatgatgcagggctccaggtgaataaccctgttcagaagcctcctgccacctatgacgatgggtctgataatttagaagtatgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaa

SEQ ID NO: 11981 - DNA, 2476 bp, Homo sapiens
  ENST00000339875
ctatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgactta

SEQ ID NO: 11982 - DNA, 1051 bp, Homo sapiens
  ENST00000510786
ataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgtctgtgcttctgcttagtacacgagcactgtctcctaaacggcaaggctatgatcacttaggcacagagagtgaccacagacctgtgcagattccacgtgtgccatagctgttcactgaagagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagct

SEQ ID NO: 11983 - DNA, 2912 bp, Homo sapiens
  ENST00000512214
gagagatatgagcatgctgcagaagaacaaataagagggagaaaaaatgactttcaccttcaaatctcaagccccaggtggagggagctttacacagattcttcagattcatcttccacagatgagagtcattggattcaggcaaaaagaagagcccaggttaaattcagactgtcaagaagaaggaggagaaataataataagccgtgtgaaaacttagctgggtcttccactcctaacggaattgagctcgttgatctgggatccaaaggtaaagagcaacaagagctgattgaatgtgagagttgctctttaaatctccacagaggaaaacatacaaggtaccaagaatgcaacccttctctgactcaagggtcctctgaaattaagagatcctcaaggaatcatgagaagagcaaaggcagatatcaccacagagatcctcagctcttgcaaagtcttaggaaaaatgaaataatgaagaagacattttcagaaacagattccagcactgaaatactgggagttccagaaggcagcaaggacatgaatgatgcagggctccaggtgaataaccctgttcagaagcctcctgccacctatgacgatgggtctgataatttagaagtatgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaaggtacagtatccataggaattggtttgggagggaccatttgcaaagcagacttgttttagaaatctatttcctttgccaatacgattctcctaatatgctaatatccattaagggtatgtgtcttgtgttgagctcagtgcacaaaatttatctaagtgtttgcagataatccttcctttcttctatgttttatattctagagcttctgattgatatattactttcaatgcttttttaaaagtcagtgtgtgcacgtaatagatataaacatatatatgtatatgcatgcaaaatgcacttgtaattcaatgtaattgaattgatgagaactatgatagcattgtgcttacggaagccagttctcaagaaggttacatgatacattgccttaaacaacatcaactcatcaaatttcttacaagttatttattaggtaatagaagagaatgatttcttctataaagtgtgtactatttatgtttgcttttatttgggaattggtttaatggcacatgtgtaattagagtaggtagaaataaaaagtactattttccatattgtgcatcaggctgtaagagagaggtaagtgtattttgtatctgtaatgtttgtcttcaaattcctcatttatgttatatttttctgaagaagaaaggtaagactgtgagtcagatacaaagttagtgtctcactcaaagccaccgaagaacagcttgtaaacaatacaaacaaggacaatgaacttatacaattcatgtttgatagctggacttctggattttagcatgtaacttatttatctttttgcctaactgtagccttacatatatggctgcctcagtttccaagggagagtatgaagaccacagtttaaataatgaatcatcccagagttgctttttttatttaaattgaatgcaaagcaaaagttataggacattgcctggaaagaaacacaacgagttccagaatgagcagagttgaaatgcaaataagaatattctagcacatatctgattgctggctgaccattgcaattcttcattaattctgtaaattgtggagggagagaatcacattccttgcttttgtggtagcctcaatttttaaaatctgcaaatggtttatagctatcaaaaataatgcataaaattcctttaggatatgtgtggtctttttttaacaatggggtaacctgagtgctgcagggtaaccctgtttttctagggcccagaggtgtcaatgccagaaatagaaatggaccctgattccttgtcctttgcttcatccgctggacagatgctgagcattgtctgcagtagttaaatggcacattgtactccacgattttccaaatgttttttcttagttctcagggaactacaaattatttcatagaatctatatatttcttcattttttttctcatgctaaatttacataaaattttcatttcaactttgtcaaatacagtattttaatttgagggccacgatctaggataataacatattctaattttctcttctttaccatatctatcaccactactcatttttgtttaattaaaaaacatgctgctgagaagaaacttgaaaagtctttttattccaccgccagcttttgtagtatctagtataccctgtcaatacaactttcatcctttgttaatattccattctcaataatttacaactctcttaggaaatcttatttttttcctcaacaaacacacttataaaccagagaaaggcagcaaatatgtctatctttttaaatattcatgataatggaccaggcacggtggcttacacctggaatctcagcactttgggaggctgaggcaggcgtatcccttgagcccaggagtttgagaccaacctgggcaacaaagtgaaatcttgtctctacaaaaaagttaaaaaaaaaaaattaacctggcatggtagcacaaacctgtagttccagctactcaagaggctgaggaaggaggatcccttgagcctaggatttcaaggttccagtgagctttgattgcaccactgcagtcaagcctgagtgacagagccatactttgtctccaaaaaaaaaaaaaa

SEQ ID NO: 11984 - DNA, 558 bp, Homo sapiens
  ENST00000505517
tatattctctgttctgcattataagcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaaggtacagtatccataggaattggtttgggagggaccatttgcaaagcagacttgttttagaaatctatttcctttgccaatacgattctcctaatatgctaatatccattaagggtatgtgtcttgtgttgagctcagtgcacaaaatttatctaagt

SEQ ID NO: 11985 - DNA, 656 bp, Homo sapiens
  ENST00000507270
gtccgctagctggggaggagcgctccacccgcaactgacaaaggatgggagaatgcccgcgccccgggatgccggccgcacgcagcctggcggccgcctgagctacttcaccctccgccggaaatgtaccccaaaagaactctgagagaatatactcaactgtcctgctgtgattaaacaagactgctgtattttaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaag

SEQ ID NO: 11986 - DNA, 554 bp, Homo sapiens
  ENST00000511245
agcaacatgaccagcagccacgtttgttgtaattttttaaatatgtggaaaaaaagcaagatatcaaccatgtattaccttaaccaagatgccaaattatctaacttgtttctccaggcaagcagcccaacaacagggacagctcccaggagccagtcaaggttgtctgtctgtccatccactcaggacatctgcagatctgccatcttgcatgacatgtcagaagagtcatttgagtattgcacccctgtcatggtgctgagccctgctaggaaggagtctggtaagaaatcagtaatacaaagacctaggaggaggagaaaagcctctgagagatatgagcatgctgcagaagaacaaataagagggagaaaaaatgactttcaccttcaaatctcaagccccaggtggagggagctttacacagattcttcagattcatcttccacagatgagagtcattggattcaggcaaaaagaagagcccaggttaaattcagactgtcaagaagaaggaggagaaataataataagccgtgtgaaaacttagctgg

SEQ ID NO: 11987 - DNA, 499 bp, Homo sapiens
  ENST00000510696
acaatgctcttaggggagagggggtgctccagtgacaaagcagttcaattatgacttgcagtaaatcatcctttggagaatgcagtactccctggattatttgttcttgcatttcttttaactcccctttcaatgtgtttaacattttgaccagaagactctggcctctgctgcacagtgtctcaaacactatttttcccctctttgtttagacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatgggagaaattcaatgggcagaaacaaagagaagaacaaggaagtcgagaatgaaaaatccccagggcgatctgcaagtcgatcaagtaacatttcaaaagcaagcagcccaacaacagggacagct

SEQ ID NO: 11988 - DNA, 616 bp, Homo sapiens
  ENST00000503104
catgtgaagaaggatgtgtttgcttccccttccaccatgattgtgaattttctgaggcctccccaaccctgtggaactatgcttttacaaaatctgagtcataaattacagatattcttgatgaaaattcagaacataggatttattttcaaaaagaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatgggagaaattcaatgggcagaaacaaagagaagaacaaggaagtcgagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaa

SEQ ID NO: 11989 - DNA, 657 bp, Homo sapiens
  ENST00000508725
acaccggcgtggtactagtcacggagccgcacccctcggaaagcgcggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacgggcctcaacaaagactatcagaatctgtgtaaatcaatagcaccgctgagtagaaattcagttgctgaagtaaatatggattctggaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatgggaga

SEQ ID NO: 11990 - DNA, 550 bp, Homo sapiens
  ENST00000505391
gacaaaggatgggagaatgcccgcgccccgggatgccggccgcacgcagcctggcggccgcctgagctacttcaccctccgccgctgaatttggtcaggtggctttagaagcagaaggcgagaatgcccttggcatggacttggcattcttacaaagagtattttgctgtggtcacccaaagggacatactggaacaaaagaggaaaagtgaacagatgctatctggtaacttgtagctggcagattggttggtgagcaaaatgagacatccctgtgagggcttcaagaaacacagagaccctctgatatggaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatggg

SEQ ID NO: 11991 - DNA, 584 bp, Homo sapiens
  ENST00000515471
ctgcgcgcgcgccgtttctggcggatccccagtgcgcggcgcgctgtttacaccggcgtggtactagtcacggagccgcacccctcggaaagcgcggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacgggaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagattt

SEQ ID NO: 11992 - DNA, 581 bp, Homo sapiens
  ENST00000510075
acaccggcgtggtactagtcacggagccgcacccctcggaaagcgcggagtcgatgacagccacttcacaggctcacgcgctcctagtgtgggcttgaaggggacggggaccgattaccaaaggagagcgctgagtacggaagacacagggcagcctttgtcttgggtttagcgctgatgcgctcaaccctgagtcgggttcactgcaactgttgtgtccgatttcggttccctgcaaccgccctcctgggcgagagatgtcattgtgttcctgcggccagcgggactgagagctgggacttaagacgccaggagggtcctgcgctcacggatgcttttacaaaatctgagtcataaattacagatattcttgatgaaaattcagaacataggatttattttcaaaaagaaatgtaccccaaaagaactctgagagaatatactcaactgtcctgctgtgattaaacaagactgctgtattttatggggtttcagcatgttgcccaggctggcctcgaactcctggactcaagcgatccacctacctcagtttcccgaagtgctgggattacaagcatgag

SEQ ID NO: 11993 - DNA, 5367 bp, Homo sapiens
  ENST00000274056
tattttcagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaagtcgatcaagtaacatttcaaaagcaagcagcccaacaacagggacagctcccaggagccagtcaaggttgtctgtctgtccatccactcaggacatctgcagaatctgtcactgcgaaggggatgaagagagccccctcatcacaccctgtcgctgcactgggacactgcgctttgtccaccagtcctgcctccaccagtggataaagagctcagatacacgctgctgtgagctctgcaagtatgacttcataatggagaccaagctcaaacccctccggaagtgggagaaactacagatgaccacaagtgaaaggaggaaaatattctgctctgtcacattccacgtaatcgcgatcacctgtgtggtttggtctttgtatgtattgatagaccggacagcggaggaaatcaagcaaggcaatgacaatggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtagcctgtcaaagaaagatgtcctacattaaaaaaggtgacttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaaccttagttgtggtttccacaatttttgcctaacagactgatatttgtatttgcaacatccaaacacacatacattttttaagattttacaagggtctgaacatataattattttaaagcaaacctacgttgactaactcatgacatggtacaaataaataaatacacaaacagagggaaaccaatgaaaataaactatgtggactttcaaacctgctttaaaaaaagagttcaagagaaatcacaatgtaatctaaagcgggactgtctcaagaataagtcttggatatagaaaaataagcatataacagcatttttctgttcagagataatagtggattcagataattgcatggataataaacattaaaagcaagatattagaatctaagaggtttggtgatagcaaaaaacaaagctgtttcc

SEQ ID NO: 11994 - DNA, 1741 bp, Homo sapiens
  ENST00000332432
ctccaccgaacggccgcgcctgccgccgccgcagctgcagaaccttccgcatcccctccccgtcccgccccctagccccaggcgtccgggccccctccctccttttcccctctccctcccgccccctccgcgctctctttccctgcagccagagcccggcccgccagccgggccggcaggagggcggcggcggcacaaccatgagctttgagggcggccacggcggcagtcggtgtcgcggggcggagagcggggacgccgagcctcccccgcaacctcccccgccgccgccgccgacgccgccgccgggagagccggccccggtccccgcggccccgcgctacctgccgccgctgcccgcgtcccccgagacccccgagcgcgccgcggggccaagcgagccgctaggggaggtggccccgcggtgcaggggagcggacgagctgccgcctccgcccctgcccctgcagcccgccggccaggaagtggcggcggccggcgactccggggaaggtccgaggcgcctcccggaggcggcagcagcgaaaggcggccccggggagtctgaggccggcgcgggcggcgagcgcgagcggcggggcgccggagaccagcccgagacgcgctcggtgtgcagcagccgcagcagcagcagtggcggcggcgaccagcgcgctgggcaccagcaccagcaccaccagcccatctgcaagatctgcttccagggcgcggagcagggtgagttgttgaacccctgccgatgtgatgggtcagttcggtatacacatcagctgtgcctgctaaaatggatcagtgagagaggttcctggacctgtgaactttgctgttatagataccatgttatagccattaaaatgaaacaaccttgccagtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcataggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctgagaaaaagagtcctcttgttcttcgttgtctggtttgtcacatcttttataagttggtacttgaaatcattatacatataatttaactatacttggttaaaagaataatgaaagttatccttaaggccaaaactattttttcttgcttgttttaaatatatttttatgaaagcttt

SEQ ID NO: 11995 - DNA, 584 bp, Homo sapiens
  ENST00000507111
agctgtgcctgctaaaatggatcagtgagagaggttcctggacctgtgaactttgctgttatagataccatgttatagccattaaaatgaaacaaccttgccaggtctcattgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctga

SEQ ID NO: 11996 - DNA, 469 bp, Homo sapiens
  ENST00000505509
agttccctgcaggtgagggatttttttttttttccagaaagaaaactgttagctctgccctgaagatgagtcccacagaggttttgcagggtggagttaccgagaaattgacttcgggggtgagttgttgaacccctgccgatgtgatgggtcagttcggtatacacatcagctgtgcctgctaaaatggatcagtgagagaggttcctggacctgtgaactttgctgttatagataccatgttatagccattaaaatgaaacaaccttgccagtggcagagcatttctataacactggttgagaaagttcagatgattgctgtaatcctaggatccctgttcttaatagccagtgtgacttggctcctctggtcagccttcagcccctatgcagtgtggcagaggaaggacatcctttttcagatctgctatggaatgtatggttttatggatctagtgtgcataggt

SEQ ID NO: 11997 - DNA, 4275 bp, Homo sapiens
  ENST00000612661
cccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgatggggtcacaatggggaaattgaagtggtgcataacattgccaaaatagtgtgccactagaaatggtgtaaaggctgtcttttttttttttttaaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacatttccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatccttttttttttttttttttgaaagtgtgttagcatcttgttactcaaaggataagacagacaataatacttcactgaatcttaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataa

SEQ ID NO: 11998 - DNA, 1699 bp, Homo sapiens
  ENST00000329421
gtacccgaccgccagcgtcgcctgctgcgcaagtggggcctgcgagccaaccccgcctccgcccctcgattgggcgcgcatttaaatgtccggccccgccccgagctccgggcgcttatatataggcagctcggcgggcggcgggcggcattctggcgcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttagtggtgc

SEQ ID NO: 11999 - DNA, 2153 bp, Homo sapiens
  ENST00000622835
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacattttt

SEQ ID NO: 12000 - DNA, 4400 bp, Homo sapiens
  ENST00000614617
cagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgcttttttttttttttttttgtgagacagagtcttactctgttgcccagactggagtgcagtggtgcgatctcggctcactgcaagctccgcctcccaagttcacgtcattttcctgcctcagcctcccgagtagctgggactacaggcacctgccaccacgcccagctaatttttttgtatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactcccttttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtatttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaaaaaaaaaaaaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgta

SEQ ID NO: 12001 - DNA, 576 bp, Homo sapiens
  ENST00000611349
cccaggtgtgctgcgacggacggctgcccgcgctcggcgctcagcctgccatagcccgcgggggaggccggagccagggatccggggaggcccgcgtcccgccaggtttcgctctgcggacgcaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagtt

SEQ ID NO: 12002 - DNA, 1908 bp, Homo sapiens
  ENST00000622563
gcggggcggggcgcgcacctcggggcgatctcggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaa

SEQ ID NO: 12003 - DNA, 1563 bp, Homo sapiens
  ENST00000611064
caggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtattttta

SEQ ID NO: 12004 - DNA, 1584 bp, Homo sapiens
  ENST00000612528
caggtgtgaaaatcacaaatgtcaaatgatggaagatccaggaatcgggacaggcgctacgatgaggtcccaagcgacctgccctatcaagataccaccataagaacccacccaattcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccacctcccaaagtgttgggattacaggcgtgagtcaccgcgcccagctggtattgcttttctattccctttggacat

SEQ ID NO: 12005 - DNA, 2153 bp, Homo sapiens
  ENST00000325631
gcccgataccggtttcagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacattttt

SEQ ID NO: 12006 - DNA, 4376 bp, Homo sapiens
  ENST00000454295
cagagtcctgggcagcgtgcgcgctcttcctggcggctgcgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtatttttagtagagacgaggtttcaccatgttggtcaggctgggaaactactttttttaaaaaatagcaagtttactatttatttactgcctttttaatgctagcctctgtggtagagaagcaagcgcttcccaaatcagcttccaattggtttaaccagtatgcaacattaaagattttactcagacatttttaaacgaattcaaatgttctaagggcctttactaagaatggaaaaaatcctgtgttcatctttcatctgtgaccaatttcatattcatctatctcatttaaatgtgtcatcattttagagatcgtatcctggcagtgtgatgggcaagtggaccatcaattctggtgctactttttccttttttactcaggcaggttcctaggatttttctgggacaaatttctcttcctagagaaattcctaggggatttctaaaggatttttctaagggaaaaagggtgacatctttcaaaggtgtcatttattcccttgaaaggtgtttgaatcccagatcaacattttcagacatcctgatcttgggcaaattgcttaatctctctgtgcctgtttcctcttctgtaaaatggggctaataatagttccttcctcatagagttgttaggattaaaggagttactaatatggtaggaactatattagtgtttgtgaagtctactgaagtgtttgtgaaatgaataaattataaagaatgagtctcaagaaaaggtccttaatgagcaagcccaacctacttaaccaaaagcccaagtgtctggtgcctttctggtttgtggtgttaactcatggccttagcctggtgcttcactgtggctctgtggcccctggggttccacatggcctccctgtctttcatcagtgtgactgtacatctctccatctccccatagtccagcctgccctggacacattgaattgtatgaatggtattgcttttttttttttttttttgtgagacagagtcttactctgttgcccagactggagtgcagtggtgcgatctcggctcactgcaagctccgcctcccaagttcacgtcattttcctgcctcagcctcccgagtagctgggactacaggcacctgccaccacgcccagctaatttttttgtatttttagtagagatggggtttcaccgtgttagccaggatgatctcgatctcctgacctcatgatccacccgcctcagcctcccaaagtgttgggattacaggcgtgagtcaccgcgcccagctggtattgcttttctattccctttggacatacatgctacagtcccacaatgtagcatttccttggaaactccctttttttttttttttgagatggagtttcgctcttgttgcccaggctggagtacagtggtatgatcttggctcactgcagcctctgcctcctgggttcaagcgattctcctgcctctgcctcccaagtagctgggattacaggcacccaccaccatgcccagctaattttttgtatttttagtagagacaggatttcactatgttggccaggttggtctcaagctcctgacctcagatgatctaccagcctcggccttctgaagtgctgggattcaggtgtgagccactgtgcccagcagggatgcttcatctttctaagaattatcttggctttggactttattcataaatgttttatttctgttagtatgaacaatagactgccttaacaaagtttttttttaaacaaaatcgttcttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgta

SEQ ID NO: 12007 - DNA, 576 bp, Homo sapiens
  ENST00000515844
cccaggtgtgctgcgacggacggctgcccgcgctcggcgctcagcctgccatagcccgcgggggaggccggagccagggatccggggaggcccgcgtcccgccaggtttcgctctgcggacgcaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagtt

SEQ ID NO: 12008 - DNA, 1908 bp, Homo sapiens
  ENST00000512803
gcggggcggggcgcgcacctcggggcgatctcggtgctccttacctgggaggtctcccggcttagtttcggcctcgttgggtcggaatctccaaagacagtgggtttcagccagaaacgcgaagacgaacgcctagccggcgcgggcagaaccgaggacacaatgagatttgtgggaccgggcgcccagaggctggcgcgggggagaccccacagctaaaatgctcggtacccccgggcagtcgtgggttagttagaaccgcagagcctttcccgacccctcggaagcgcagaagtatccgaaatctacccgtttcttgggtccagcaaaacttttaagccaggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaa

SEQ ID NO: 12009 - DNA, 1563 bp, Homo sapiens
  ENST00000436532
caggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccagtagctgggattacaggcgtgcgctgccacaccccgctaatttttgtattttta

SEQ ID NO: 12010 - DNA, 1584 bp, Homo sapiens
  ENST00000413223
caggtgtgaaaatcacaaatgtcaaatgatggaagatccaggaatcgggacaggcgctacgatgaggtcccaagcgacctgccctatcaagataccaccataagaacccacccaactcttcatgacagtgagcgggcagtgagcgctgatcccttgccaccaccccctctcccattacagccaccattcggcccagacttctactcaagtgacacagaagaaccagctatagcgccagatctcaaaccagtaaggcgctttgtccctgactcctggaagaactttttcagagggaagaaaaaggaccccgaatgggataagccggtgtctgatatcaggtacatctccgatggagtggagtgttcaccaccagcctctccagcaagaccaaaccaccgttcgcccctcaactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtattgctttggtttgcctaaagttatggaggcatgaggcagctcggagacatagagaatatatggaacaacaggagataaatgagccatcattgtcatcgaaaaggaaaatgtgtgaaatggccaccagtggtgacagacaaagagactcagaagttaatttcaaggaactgagaacagcaaaaatgaaacctgaactactgagtggacacatccccccaggccacattcctaaacctatcgtgatgcccgactatgtggcaaaataccctgtgattcagacagatgatgagcgagaacgctataaagctgtgttccaagaccagttttcagagtacaaagagctgtctgcagaagttcaggctgtcctgaggaagtttgatgagctggatgcagtgatgagcagattgccacatcattcggaaagccgacaggaacatgagagaatttcaagaatccatgaagagtttaagaaaaaaaagaatgatcctacatttctggaaaaaaaagaacgctgtgattacctaaagaataaactttctcacataaagcaaagaattcaagaatatgataaagtaatgaattgggatgtacaaggttattcttaacgcttatttgaaaccactttatttttttattttattttatttttttgagatgaagtctcgctctgttacccaggctggaatgcagtggcacaatctcggctcactgcaacctccacctcccgggttcaagcaattctcctgttcaagcaattagcctccccacctcccaaagtgttgggattacaggcgtgagtcaccgcgcccagctggtattgcttttctattccctttggacat

SEQ ID NO: 12011 - DNA, 5276 bp, Homo sapiens
  ENST00000337774
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacccagcttattctgtttatttctccaattgcaatttcatccttatcctgagaaaatgtctaaataggccatggaacccaggcttccccgtgacctacaagcacttattagctgtgccagctcctgcactgctgctaaggtccaagaaacccagatctctcacagagccatagaagcagagggctggagtatctgtgaggacaacaaccttgtctaacttcgcgacctcattcttgagcatttctactgatgagaaactcactacccccaattgcagctcattcaactttaaaattgctgctttttgaatcactgattgtgaatattaatttaaaaaaataagtaagaaaatgttttaaatgtgctgcctctttaaaaggtctcctctttgtgcaaccaaaacccacctctctagaatacagtttgtataactgaagctataatttcataccatgagtgctgctgttagcaataataatcatgcccggattttattaacaacagaagctgttgctcgtatgaaaaaacaaacattagttctaataaacatctgcattgagtc

SEQ ID NO: 12012 - DNA, 498 bp, Homo sapiens
  ENST00000468121
ggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctggggcaggacacctgggatggaggtccaggaacctgagtccaagtgcaagatatgattctccagacacgtg

SEQ ID NO: 12013 - DNA, 5982 bp, Homo sapiens
  ENST00000480349
ttgaaattatttgcattttgagtggactctctagctaatcaaaaagatgaatttggagtcctaaagttaaaatcacaatgtctaaatggcactcagggataaattatatctcactgtttcccaaaatgaccaggtaaaattcaggaggacatggaactttggaaattttaccagggctctggaaattctgacagttgatgtccaccattggccagctagtacctagaataggccatttaactggaaaacagatccttaagaaccactagttccatttactaaaacagccctgggtttgaggtcaaatcttgctctcattctgatagtaacttgctgtatgtccttagacgagtcaagtctcctctctgggctcatagataaaataaagaggacattctagattgcctacttcaggtttctttccagctgtgacattctatgattcatctatgattcttcgactctggcataggctgttatacctaagattaggatttccttaagaatgaaaagattgacaaatttgggtccagagcctctgatatggccatgaaaagatgccctgactctcagctgactcacactgggctccatcagtgctgacaactcccctaagactgagctggactggaaagctccccaaagaccacctctgaggagcaggcatctttattcatgtcctgtactgggaattatggctcaaacatgcggccatcaacaattatagaaaatgaacaggggaagactgaaagctgatccacctccaaccctgcctcctggcttctatggccaagcaagctgcctgtagagaggcagcagggtggggctgtgtactcatacaggagctgggtttttttattttttgtgccaaactccaatgtgagcacattagctgctgttactcagcctaggattgggactagaagaacaaaagattatttagtttatgtcagctagagttttctcactaagccaagggcttcattcttgggcagaagaggcagagaggattgcacaataaaactagaagtaaaagaaagaggccctggtgggtaaaagactggagtctgcttaaacctcagtagaccttcccctacccaaaattgacactgggcaggtgagttgaccacacagtagtaccataatgaatggaagagacctcaaaagcaggaccatgggtagcttcacaggctgtacactgcacaccccaggggtgcccttcagaggcattataacattgctttctggaattgtgtgcagtgcacaacctgtacatctgcatgagatagatccatcagatagccaaaggaggatgagcaaaaggcagttgaggggtctcacttcttctctctcagttgtagactgtagagccccaggagagctggaacacgggctgatcaccttctctacaaggaacaacctcaccacatacaagtctgagatcaaatactcctgtcaggagccctattacaagatgctcaacaataacacaggtaagccatccatgctaagccatcccactcccgtttcacactctcggggcctcagggttggactgggggccgagacagctgtgaaaggaagaactgctcataagtgtgtagagcctgataatgcaaaacgtgtcactcacacatctcaggttctcacttttcatgagcttgtgttactgtgtccatgtggagatgcagaaacagtctcaaaaccaaaaagcaggcttttttgtttttaactttaaagctagcactgatttactaatgagttgttggtgggagcgtgaaggagtcacacactgacacaactaagagaagaaacgagaccctaaaggaagcctggaatcccccaagttaaactccttcatgtggtctgaggctgagttggggtttccaaaaaaaggccagtattactgcttcacccagactctgccttggcttctgggtgagggcaacatctcaccaggccagacccattcagcaggtaagggaccttccttcaaagacctcttcccctggtacggacaggggtccaggcagggttggggagcgaggagtggatcctctgtctccccaggtagcccagcatatcccctgaccacagctcaagcacagccacagcagtccctgtccaggccccatccatgccacctggcagagacccctggctgccccaggggctgggcagcagcacactggccagagggtgaaggaccagcaataacctgaccattggccacactgggggtttgggaggaactgggaggagaaatgcttagagacataacccgcctctccctgccttgtggcagcccaacacccgctcacatgcactcatagtccctagcagaaaaggaactctcagggagaaaggagggcccatcggctctgcctctctggcatgcaagcactgagaacattctcctgactcatctaagcctccaactcctctttgtttttgtttttgtttttgagacagggtctcactctgtcacccaggctggagtgcagtggtgtgatgtcggctcactgcaacctccacgtcctgggttcaagcaattctctcgcctcagcctcccaagcagctgtgattacagaagcttgccaccatgcccagctaatttttgtatttttagtagagacccgcttttgccatgttggtcaggctggtctcaaactcctgacctcaagtgatccgcccgcctcggcctcccaaagtgctgggattacaagcgtgagccactgcacctggccccaagtcctcatttttaaaagagggaagagttacaaagctcttagagctatttcaaaatgccagtgagatggtggccacaaatgtatgcttattaaagagtctgtcaaatggagaagaaaggaaagggcatctgtgcaacagggagccatgtgagcccaggtctttgtgacaagtgaggcggaggtgccttccaggacctgggcagcgtggggtggggaggggagcagccctcagccaggcaggagtgggattccccagagctttggacagacaccatgctgaagagtgtggtgtttatttttgggggtgacagcaagccattcgtgattctgagctgagaaaggacatggtcacattcccattttagaaagatccttcatgttgcaaagggagtttgatagaaggactaggatggtagccctgtgggtatttgaagatatttggaggttaattggtccctttggaggattgtatcccagagagtacctgccacattcttcctcattcttcttagtacatctaggctcagagacaatcgtatctgagcctagatgaccatttggaggactttgtaataactcactttagagaaattaaatacccagatctattttccatgtgttacaaatcaaccattttctccctcctctcctaacctctttcactaatccaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaca

SEQ ID NO: 12014 - DNA, 4015 bp, Homo sapiens
  ENST00000296280
agagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaca

SEQ ID NO: 12015 - DNA, 3900 bp, Homo sapiens
  ENST00000392472
tctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaa

SEQ ID NO: 12016 - DNA, 587 bp, Homo sapiens
  ENST00000495249
agacacacagggacctcagaacaaagataaggcatcacggacaccacaccgggcacgagctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggccttt

SEQ ID NO: 12017 - DNA, 2440 bp, Homo sapiens
  ENST00000169293
gccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacct

SEQ ID NO: 12018 - DNA, 1673 bp, Homo sapiens
  ENST00000392470
gggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgagggtgctgcctgctggcgaatgtgactctcctcctgttcacccacaaggctgatttttccgtgttcctcctctggaaagagcattgctttctctcttccagcactttgtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaa

SEQ ID NO: 12019 - DNA, 410 bp, Homo sapiens
  ENST00000483719
aaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgcctgggaaaggggagtgaccaggccacagaaactctcgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatat

SEQ ID NO: 12020 - DNA, 770 bp, Homo sapiens
  ENST00000460839
agcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaaggtgagcctgcaatgaacacttgtcctggagatgctggaaaatcttggctgagttgggaaaattgatattgcggaacctt

SEQ ID NO: 12021 - DNA, 563 bp, Homo sapiens
  ENST00000490558
tgaaagcatttgtcacactgtgtaatacctgcctgtgtctgtgttcctcaatctcaacactgctattgtgtgcacagcactgtgtctatctctcatcacctccatctcatgctttgctcggcagtaggcacacactggatactcaatgaatgacttatattgtgtatacagtttccattctttggaaatgtggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttccc

SEQ ID NO: 12022 - DNA, 962 bp, Homo sapiens
  ENST00000392475
ttttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgagacctacattcatgtctttcaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcac

SEQ ID NO: 12023 - DNA, 510 bp, Homo sapiens
  ENST00000465015
aaacatttctcatgaatttcaattgtagtctccggtggaattctcccactccagagacaccaggacccaaacaccaattctagcttattcagaagaattagaaaatgaaaatgagcttgcttcaggaaagtgtaatgaaagctcattttatgccaaaagtgcaaacagcacaggcttcagggtgatggaaaacaaaaggaagctcgcagtgctgaggaagagcatgtgggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacat

SEQ ID NO: 12024 - DNA, 542 bp, Homo sapiens
  ENST00000439271
agccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggca

SEQ ID NO: 12025 - DNA, 553 bp, Homo sapiens
  ENST00000425937
agctcacaggcaagtcaagctgggaggaccaaggccgggcagccgggagcacccaaggcaggaaaatgagggctctgagaagggagctgtgggtgggctgggtgccttccccaggactccaggagacataaaacttgaaacgggagacttcgtgcaaatcctgctccggacgctgctgaagctcagatttctcccactgcctgcacagggtgctgcctgctggcgaatgtgactctcctcctgttcacccacaaggctgatttttccgtgttcctcctctggaaagagcattgctttctctcttccagcactttgtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaa

SEQ ID NO: 12026 - DNA, 3832 bp, Homo sapiens
  ENST00000373765
acaaccgtgccggctgctgcccgtgctgccagaactatgagggtcctctctggcactagcctcatgctctgcagcctgctgctgctgctccaggccctgtgcagccctggcctcgccccccagtccagaggccatctctgccggacgcggcccacagacctggtgtttgttgtcgacagctctcgcagcgttcggcctgttgaatttgagaaagtgaaggtattcctgtcccaggtcatcgagtcgctggacgtggggcccaatgccacccgggtgggcatggtcaactatgccagcaccgtgaagcaggagttctcgctgcgggctcatgtctccaaggccgcactgctgcaggctgtgcgccgtatccagccgctgtccacaggcaccatgaccggcctggccatccagttcgctatcaccaaagccttcggcgatgcagagggtggtcgttccaggtcccctgacatcagcaaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcgtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgtgtgcatgtgtgtgtgtgtgtgtgtgtgtgcacgtgcgcctgagggtgggcatgagtcttgccagaatgtgagtgtgagagtgataatgcaggggtgagtgtgagagggactgcgtttgcatttttataatcaaaagcttaatatattcccatcttttttagttaaccctttcttgactctgagtgctgtgaatttctttactgatttctctattctccggtgagaaacaattaaatgtgatttaacgtaagcagtgaatggggctagaggcagtgtggttatttggggaccagggaaaaggatggatgaagatgtggtgggaggggatggttggaaggatggtaacagtggtggtgacagtgatgacagtgaccacaccaaaaccagctggtgtttgtcctgccttttcagttacatattcatttagttgacctcatttcacttccagtaaccttacccagaaaagactcaaattatccccattacaaatgggaaagctgagagtctaaatgatgaaatgacttgctcagcagtgggtcgctgagagacaggacttgaatctaggactgaagaacatcaaaagaaaaaggcttcagagaaaaagggcaatgacaccagataggactcatttgttcattcattcattcgttcactcattcgttcaggtatcatgtacttacagggcaatggcggtggggggggatggtgctgtatgagacagacgtagttcctgccctaagagacatacagttgagcagggtgctcatgtcacccccaccagccagagggaccagccagaggaaaagagagtgggtttaggtcgtaccaggggtttgtgcctcctcttgatacctgggagcccacggggtgagtgtgtgtgtgagatgatgggaagggctccagcctgggcctgggctgccctaggtgcctctcccctcccgcccccaacatgccctgttggagttctgtttgtttcctgtgcacaggcggcatcacccccaacccaaagtccccaacgcagatggcagcagccccacctcagagactgcacaagagaaagactcctggccccatgttcccttcctccagccctatgtggggtctgcaggtcacaccctgagatctcggccacctcccccaggcccctgttggaccagtgctgctccggaatctccatctctgtcctctcagagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagctacatcagtacaacagcacaaatacacaagcgcgacttaactggggcacagccaccctcgcccccatgacctgactccacctcctacacagttcaccaaaccctttctctctgtccgtccctggggcaggagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcggacgccatggcctgggagctggcgggcagaagcaacagatgtccctgatgagtggagtcagagatggggtggaagccctgcctgggaataggacctcgttcttccctgcccggtgggtggagtagtggcaggaccttgtcaccaggctctgatgaaggcagggaccagcttcttgggatctttcaatcccaaactcttgcccttcactcatcgcagttctccccacggctactccaggtcctcttgaaatccgtcctctccatggacttcccacatccctctctgctctaggtttgattaacagaaggttgtaaatgaaaaccagcatctcccgagggcagccatggtctactgacagatggcaagttactttgtaacctgtaattttgtttttttgaattttgtataaataaacaggactaaactaa

SEQ ID NO: 12027 - DNA, 941 bp, Homo sapiens
  ENST00000494561
ccccctgggtcgcttccacaccaagaaggacatcaaggcggctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaacatatcccttcccagagggggctggggctggggaggggcgcaggccagtgttgggggaggcgggggcatggcccaagtgtggtcagttgggcaggcttctcttggcctgcttactgctgatgggctgcattctggcagaataagctgaagccagcttgggtgcacaccctgtcaaaagcagagactcctagaaggtaaacaagaaaatgaggcagaagccaggatctagggactggacacacaccagagtcctggacatgctctgaagaacatggagcccatggatgccccatttctcaggctcatggtgacgtgcctgaccccagtacccactcagaggtggggctgggccccagacagttcccctggctcagccaggactaggtggggaacccagcaggtctaaatctgcaactgagcagggctgggcactcgtggctcacagtaactggctgtgttttttggaaagcaccattctgag

SEQ ID NO: 12028 - DNA, 943 bp, Homo sapiens
  ENST00000477320
gggaaggcatggccctgaccttagagaccccaatttggcgatggggcatcacatccctccgggcatctcagagctgcctgcccgagggaggcgaagcagatggaaagccccccagccacgtctctcagtcagaggaaacgggtctcctcttcggccagccgggtcctcttcccccgggtgccgcctggctgtgcgacccggcagtcctcccgcctctccgggcctcagcctcctctcctggacagtcccgtgggcttccgggagcccggtgtcacaccgccccgcgtgtcgcaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcgtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgactggggctgctctcaagtacctcattgaca

SEQ ID NO: 12029 - DNA, 2077 bp, Homo sapiens
  ENST00000372756
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgggg

SEQ ID NO: 12030 - DNA, 2200 bp, Homo sapiens
  ENST00000372754
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgggaaggaccagtgtgctgaggggggacatggttgccagcaccaatgtgtcaatgcctgggccatgttccactgcacctgcaacccaggctacaagctagcagcagataacaagagctgtttggccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacgggg

SEQ ID NO: 12031 - DNA, 2127 bp, Homo sapiens
  ENST00000360607
aaatgcggccgttgcctctgtgtgctccagctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttcca

SEQ ID NO: 12032 - DNA, 1657 bp, Homo sapiens
  ENST00000353917
ctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 12033 - DNA, 1991 bp, Homo sapiens
  ENST00000537548
agtgtggctgccccggtctccccagtctcccgctgtagctgaattccagcctggcccgcagctagccctgtctgcagctccaagcgtgctgcctggcagtccccacctagggcacgctgccacgccgccgttacctggtccaagtgcccgggaggctccgcctgtcggcttcgctctgcagctgcatctctgatctgtcctgcaggctcaggctctgacacctccattctctgtccccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtga

SEQ ID NO: 12034 - DNA, 1794 bp, Homo sapiens
  ENST00000324607
gagagtttgcgccggttcgcattccccggcctcccgttcgctcccccgcgaaccaggcggccgtgcgcctctcggggcaaccacccaagagcacccgggcgggaggacgccgagcagggggtgttgcgggctgggacaggggcagccacctcccgaagatgcaggatggcagcagagccgcagccgtccagcctttcctaccgcaccacgggctccacctacctgcacccgctcagcgagctcctgggcatcccgctggaccaggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctggtactctgtgcatctttttgtgctggtgttaatgtgctatgcaatcatggtcactgctagtgtatccaatattcacagatattccttttttgtagcaatgggatatcttacaatatgccacatcagccgaatatacatcttccactatggaattctcactacggatttttctgggcctctgatgattgtcactcagaagatcacaaccttggcattccaggttcatgatggattaggtcgaagagctgaagacctttctgctgaacaacatcgacttgctatcaaagtgaaaccctcttttttggaatacttaagttaccttctcaatttcatgagtgtcatagctggtccttgtaacaatttcaaggactacatagccttcattgaggggaagcatatacacatgaagttgctggaggtgaactggaagcgaaaaggtttccacagcttgccagaaccttctcccacaggagctgtgatacacaagttgggcatcaccttggtgtctctccttttgtttttgacgctaacgaagacctttcctgtcacctgccttgtggatgactggtttgtccataaagcaagctttccggctcgactctgctacttatatgttgtcatgcaagcctcaaagcccaagtattactttgcatggacattagctgatgcagtgaataacgcagctggctttgggttcagcggagtggataagaatgggaatttctgttgggatctgctttcgaacctaaacatctggaaaattgagactgccacaagtttcaaaatgtacttggaaaactggaatattcagacagctacttggctaaagtgtgtgtgctatcagcgggttccatggtaccccacggtgctaaccttcatcctgtctgctttgtggcatggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacggtagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttattttgttcttttttaaagtgcagggagtat

SEQ ID NO: 12035 - DNA, 7751 bp, Homo sapiens
  ENST00000305997
cgggcgcgggaggaggtggcggcggagggggaggtgcgagccgggcaccgcccccggcccctccccggccttccccgcgcagagctccgaccgcgggcggcccaggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcacaaaaaaaaaaaaagaaaaaagaaattatgccagctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttttttttggttcagcctatctagccacctacaaataatcacatttctgttacctgaatttatttctcagcctgtaaaccttagtcactgttacctgtttcttgctcagtgaatatgatcttggcactgtcatctagaaagcaagatatttgattggttttctggttccttcgaagataataattccatatccagtttgactgattttcatacccctgaatcaactagttattttcatgaaatggtttttggatatctctcctctagtttggagaagtaataatcacaaagattaatattttgcttctagtacttacagtagaagaattttaaactggtacgtctactcctgttaaatagaaaggggattcgttgtattatgtgcttgcttttttttaatcaatagaataagattcaatgcatatttatgttttatattttccactattcaggtatcatgaaatcactctagagatgatcaatcaacatcatatttatacttttggttaattatatactactcagggaaaaaatgaacaaaaataactactcatccttcaatttcattttcttgaaacagtaagagtataatttggtatgcctcagctgtcaccattttataagtggctcattctgttcttaaagtaagtatttttattggaactcagggtaattgggggaatttatttagcttctaaaatatccggcaggatagagaagatttatttggcttcaaaaatgtctggtgaccacttctcttattagccactactgcccatttgcttcaaaaatatatttattggtctccaccatgtgtgacacacacaggatttccaaacataccacttttgagaaaaatgtgcagtaaaaaggaggtttctagaaagtgacagtaactcacatttaagcactagctgacctaggaggagacctggatcttcattctggttctgcctttcatgagacttaagacttggaggagccacctgtcctgtagaccccaagttcctcagccataagcaaacgggttaatcctaagagttcaggaccagttgggtgtcgtgaacggagccattagcaaggtctgtaggattcaaggacttgggcacattcacagtccacactattgtcatggtcattgacttactacttgagctcaaagccctgacatttcaaaaggttgtcatgataacagtgaaacctctgaatcccttaaatcagaaggcatggcaacatactttttctactggcaatagctcttacaatgagtgtttcataatgaaatagtctctgctgaagaaaacatgttttccttttgctctctctgctttgttggtttctgtgctgtgtggaattggagaagatatatgctctgaaatattttatacagattactgactactggacagggtttaccactatataacatctcaaagttattcaaggatatttaaagcatatttagtttagttacaccttattttaaaccgcagaaaacaatagctttaaaatttttgccattaaaataattataaatttatacttttactcaaggactagatcacagttttaggacaaaaatctctcctatttaaagttcataccttgtaagtatttagtttgtatattcatgaacaaatctggacatttatactttttttgtttccttatcaactgttcacaattattagttaattggtcttaacagttctacattataattgaaagaaaaattacttgagaaaataattgtttcagaatagtgcctactatatctgtgtcagctaaaaatttgtccagagttttagatataagctagtattttgtggagttttatccaggcgttaatagttcttcctggctgaaatttaatataggtgcagaatcctaaataacactgtgagatgtaatcttaactgccctcaataccttataaaactgctgcatttaacccagtgtgcatttaatgagtggctggtcgttgatacactcatcttagatgctgaaatttctgttttctccagcccttgtaaaagtgggtttcttgatgaacgcgtgctcccaatgctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagccagaatttagtatttacatttgccttcccaagttgagaatagaatgtggtgttctgtgctttctgtttttattattccaaaatatttttttaaagaagtgttatttttcaacagattcataaattagttcctgatgtacggtaaattaaaactcccactgtgtcagtcaaactgagatgtgctcatttcataaccactcatttctagtctgtcagagctgcactggtggcttattgctggtttttaaaggtgtttttaacttacatgtaacatgtttaggacatgttttttttttctaatttgtgtgtctttacaactgattaaacagtagtttaaaaata

SEQ ID NO: 12036 - DNA, 1227 bp, Homo sapiens
  ENST00000471753
aaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagaattttctgaaggagagataaaaactgagttaaataaagatgatcagaatggatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcg

SEQ ID NO: 12037 - DNA, 416 bp, Homo sapiens
  ENST00000486315
tcctttccactagaagcgaggtgtgtactgcgtgcatgtttgctgagcgctcaccacgggctaggctccatgcccagttcctgtgaggagaaaacacgtttctatgtgcccggcaggtaggaggcactcacaaaatgttactttgtctttacagaattttctgaaggagagataaaaactgagttaaataaagatgatcagaatggatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtg

SEQ ID NO: 12038 - DNA, 576 bp, Homo sapiens
  ENST00000473432
gatttaaggatctctaggcagtgttgtcttaaacttttcttttttttttggaaacttttattttaatacagaatctaatctacagaaaagttgcaaagaacttctatatgccctttacccagactcaccagtcatttatgttttccctgttacttcctcatctcccctctctctgtcttttatacacagtgtgtacaatgtgtattcgcttttttagaacgaactttatccatagtagcagtgtacattcccactagcaacttaggagagtttcagttactctactccacatccttccaacagttgatatcaccagtgtaactgcataagtaatgttaatttaaagatacagcaaatgtttttgtttctttatttcagatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattg

SEQ ID NO: 12039 - DNA, 1351 bp, Homo sapiens
  ENST00000486484
gagcgggcgagcggcgcgggcggccggagcgccgaggcccggccatggccaccaccagcaccacgggctccaccctgctgcagcccctcagcaacgccgtgcagctgcccatcgaccaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctaattttctgaaggagagataaaaactgagttaaataaagatgatcagaatggatgagaaataactttagacattatttcattgaaccttcccaactgaaattattttatgatgttataacat

SEQ ID NO: 12040 - DNA, 525 bp, Homo sapiens
  ENST00000494760
tatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctgtaagtatcaagaattttattttacaattcaatggtccacttgaactgttaaaaaggctgagtacatctctcttacaaggtagaccctctttccttggtcgtggtcagtattgtcctttccactagaagcgaggtgtgtactgcgtgcatgtttgctgagcgctcaccacgggctaggctccatgcccagttcctgtgaggagaaaacacgtttctatgtgcccggcaggtaggaggcactcacaaaatgttactttgtcttta

SEQ ID NO: 12041 - DNA, 754 bp, Homo sapiens
  ENST00000477073
ggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccagttactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctag

SEQ ID NO: 12042 - DNA, 713 bp, Homo sapiens
  ENST00000474341
gaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatgtaaggtcatgagatttatctggagcctttacagcatgtattgactgcggttgttcagaagctcttagtttgtgggctgtccttgttatttcacttgaccatctgtacaacattacctgtggagtacaacattgatgagcattttcaagc

SEQ ID NO: 12043 - DNA, 580 bp, Homo sapiens
  ENST00000462696
acagcgcgagcgggcgagcggcgcgggcggccggagcgccgaggcccggccatggccaccaccagcaccacgggctccaccctgctgcagcccctcagcaacgccgtgcagctgcccatcgaccaggctgcccgccacatgattcccgggtgtctttccccttccgtgtgtctcacgtacctggcagagtccacaggcgaaaagtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacatta

SEQ ID NO: 12044 - DNA, 550 bp, Homo sapiens
  ENST00000460786
gtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcagggtccttgggctaggtcagtctgagtttcctagagaaggcgctcaagagtgcgttttacttctatgcatttcacctattttcagtgttctccattcaacaccagtattcagttgagtagtggaaataatttctggcatttgttccttcaaaggggatgtattttcttcctggtactagatgaatctttttgtcctgtaacaaaactgattatatgtctgttgtgaaataaa

SEQ ID NO: 12045 - DNA, 2598 bp, Homo sapiens
  ENST00000615453
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 12046 - DNA, 2471 bp, Homo sapiens
  ENST00000621455
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 12047 - DNA, 2392 bp, Homo sapiens
  ENST00000612053
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 12048 - DNA, 2598 bp, Homo sapiens; identical to SEQ ID NO: 12045
  ENST00000621612

SEQ ID NO: 12049 - DNA, 2471 bp, Homo sapiens; identical to SEQ ID NO: 12046
  ENST00000611602

SEQ ID NO: 12050 - DNA, 2392 bp, Homo sapiens; identical to SEQ ID NO: 12047
  ENST00000620636

SEQ ID NO: 12051 - DNA, 2598 bp, Homo sapiens; identical to SEQ ID NO: 12045
  ENST00000621875

SEQ ID NO: 12052 - DNA, 2471 bp, Homo sapiens; identical to SEQ ID NO: 12046
  ENST00000621146

SEQ ID NO: 12053 - DNA, 2392 bp, Homo sapiens; identical to SEQ ID NO: 12047
  ENST00000612567

SEQ ID NO: 12054 - DNA, 2596 bp, Homo sapiens
  ENST00000617012
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatagcttggcctatgacaggtcaccgtgtgtaaatctttcccaataaagtgttgcacaaag

SEQ ID NO: 12055 - DNA, 1811 bp, Homo sapiens
  ENST00000610862
cccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaatgtgaggcctgaca

SEQ ID NO: 12056 - DNA, 3039 bp, Homo sapiens
  ENST00000622772
atgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagcttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatagcttggcctatgacaggtcaccgtgtgtaaatctttcccaataaagtgttgcac

SEQ ID NO: 12057 - DNA, 2030 bp, Homo sapiens
  ENST00000613056
ggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatagcttggcctatgacaggtcaccgtgtgtaaatctttcccaataaagtgttgcacaaag

SEQ ID NO: 12058 - DNA, 564 bp, Homo sapiens
  ENST00000616849
agctcaggtgggccagggtggcggcgcccagtggcgaggcgagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcaccta

SEQ ID NO: 12059 - DNA, 911 bp, Homo sapiens
  ENST00000620231
agggtggcggcgcccagtggcgaggcgaggttacacggcggcagggtctctgcgggctggcgggtgcggggcggccccggaggcgcgttggaactcggggctggcgcaaccgcctgtggctctgccggggatgcgctgggaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgc

SEQ ID NO: 12060 - DNA, 465 bp, Homo sapiens
  ENST00000615450
ggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgtgcgcctcctgcttttgcccagct

SEQ ID NO: 12061 - DNA, 556 bp, Homo sapiens
  ENST00000618692
agtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctg

SEQ ID NO: 12062 - DNA, 600 bp, Homo sapiens
  ENST00000611939
agtggaaaataaaggggggggaccctctggaaggttccaggcttatgctgtcccttccccctgcaggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgc

SEQ ID NO: 12063 - DNA, 544 bp, Homo sapiens
  ENST00000615263
cagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaaggtcagactcggggcttgccactcccctccagcctccctgtgggccccttcacctcccactttacctcccccttcagtggctccccgggattttacctccaacacaccctgggggtgggacgtcacctcacttgctgccctgggcacagcattccccattcacatgcccttgggcaggtcttcacctcccagctcctcctggggtg

SEQ ID NO: 12064 - DNA, 927 bp, Homo sapiens
  ENST00000621905
ggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctca

SEQ ID NO: 12065 - DNA, 919 bp, Homo sapiens
  ENST00000619104
acaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctcc

SEQ ID NO: 12066 - DNA, 2392 bp, Homo sapiens
  ENST00000614279
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggctgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatagcttggcctatgacaggtcaccgtgtgtaaatctttcccaataaagtgttgcacaaaggc

SEQ ID NO: 12067 - DNA, 2033 bp, Homo sapiens
  ENST00000437868
ggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaaggca

SEQ ID NO: 12068 - DNA, 2076 bp, Homo sapiens
  ENST00000338624
gactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaag

SEQ ID NO: 12069 - DNA, 2529 bp, Homo sapiens
  ENST00000245615
gttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaag

SEQ ID NO: 12070 - DNA, 3039 bp, Homo sapiens
  ENST00000494142
atgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagcttggttgctaaaggactcatagcttagcaaccatagcccttcaaggcttttcatggctgtggcgggccccattaggtaccaaaagaagaagaaccccattgtcagtggactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcac

SEQ ID NO: 12071 - DNA, 707 bp, Homo sapiens
  ENST00000449249
cacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagc

SEQ ID NO: 12072 - DNA, 1797 bp, Homo sapiens
  ENST00000391754
cccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaa

SEQ ID NO: 12073 - DNA, 1585 bp, Homo sapiens
  ENST00000495279
ggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaag

SEQ ID NO: 12074 - DNA, 876 bp, Homo sapiens
  ENST00000414665
cggcggcagggtctctgcgggctggcgggtgcggggcggccccggaggcgcgttggaactcggggctggcgcaaccgcctgtggctctgccggggatgcgctgggaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgc

SEQ ID NO: 12075 - DNA, 557 bp, Homo sapiens
  ENST00000453320
agctcaggtgggccagggtggcggcgcccagtggcgaggcgagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctacc

SEQ ID NO: 12076 - DNA, 493 bp, Homo sapiens
  ENST00000464098
agtggaaaataaaggggggggaccctctggaaggttccaggcttatgctgtcccttccccctgcaggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttctt

SEQ ID NO: 12077 - DNA, 629 bp, Homo sapiens
  ENST00000474910
actcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacag

SEQ ID NO: 12078 - DNA, 564 bp, Homo sapiens
  ENST00000491216
ctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaaggtcagactcggggcttgccactcccctccagcctccctgtgggccccttcacctcccactttacctcccccttcagtggctccccgggattttacctccaacacaccctgggggtgggacgtcacctcacttgctgccctgggcacagcattccccattcacatgcccttgggcaggtcttcacctcccagctcctcctggggtg

SEQ ID NO: 12079 - DNA, 465 bp, Homo sapiens; identical to SEQ ID NO: 12060
  ENST00000495968

SEQ ID NO: 12080 - DNA, 2471 bp, Homo sapiens
  ENST00000431666
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaaggc

SEQ ID NO: 12081 - DNA, 2030 bp, Homo sapiens; identical to SEQ ID NO: 12057
  ENST00000614745

SEQ ID NO: 12082 - DNA, 2596 bp, Homo sapiens; identical to SEQ ID NO: 12054
  ENST00000619855

SEQ ID NO: 12083 - DNA, 3039 bp, Homo sapiens; identical to SEQ ID NO: 12056
  ENST00000610921

SEQ ID NO: 12084 - DNA, 919 bp, Homo sapiens; identical to SEQ ID NO: 12065
  ENST00000614760

SEQ ID NO: 12085 - DNA, 1797 bp, Homo sapiens; identical to SEQ ID NO: 12072
  ENST00000618899

SEQ ID NO: 12086 - DNA, 923 bp, Homo sapiens
  ENST00000616653
ggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtag

SEQ ID NO: 12087 - DNA, 911 bp, Homo sapiens; identical to SEQ ID NO: 12059
  ENST00000617324

SEQ ID NO: 12088 - DNA, 600 bp, Homo sapiens; identical to SEQ ID NO: 12062
  ENST00000619692

SEQ ID NO: 12089 - DNA, 564 bp, Homo sapiens; identical to SEQ ID NO: 12058
  ENST00000617095

SEQ ID NO: 12090 - DNA, 544 bp, Homo sapiens; identical to SEQ ID NO: 12063
  ENST00000616410

SEQ ID NO: 12091 - DNA, 465 bp, Homo sapiens; identical to SEQ ID NO: 12060
  ENST00000618614

SEQ ID NO: 12092 - DNA, 556 bp, Homo sapiens; identical to SEQ ID NO: 12061
  ENST00000611302

SEQ ID NO: 12093 - DNA, 2392 bp, Homo sapiens; identical to SEQ ID NO: 12066
  ENST00000620371

SEQ ID NO: 12094 - DNA, 2033 bp, Homo sapiens
  ENST00000615872
ggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggca

SEQ ID NO: 12095 - DNA, 2076 bp, Homo sapiens
  ENST00000615282
gactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 12096 - DNA, 2529 bp, Homo sapiens
  ENST00000613746
gttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 12097 - DNA, 3039 bp, Homo sapiens
  ENST00000610768
atgcccaccccccagcaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcac

SEQ ID NO: 12098 - DNA, 707 bp, Homo sapiens; identical to SEQ ID NO: 12071
  ENST00000621334

SEQ ID NO: 12099 - DNA, 1797 bp, Homo sapiens; identical to SEQ ID NO: 12072
  ENST00000619670

SEQ ID NO: 12100 - DNA, 1585 bp, Homo sapiens; identical to SEQ ID NO: 12073
  ENST00000612092

SEQ ID NO: 12101 - DNA, 876 bp, Homo sapiens; identical to SEQ ID NO: 12074
  ENST00000619844

SEQ ID NO: 12102 - DNA, 557 bp, Homo sapiens; identical to SEQ ID NO: 12075
  ENST00000612519

SEQ ID NO: 12103 - DNA, 493 bp, Homo sapiens; identical to SEQ ID NO: 12076
  ENST00000621649

SEQ ID NO: 12104 - DNA, 629 bp, Homo sapiens; identical to SEQ ID NO: 12077
  ENST00000621527

SEQ ID NO: 12105 - DNA, 564 bp, Homo sapiens; identical to SEQ ID NO: 12078
  ENST00000611912

SEQ ID NO: 12106 - DNA, 465 bp, Homo sapiens; identical to SEQ ID NO: 12060
  ENST00000621865

SEQ ID NO: 12107 - DNA, 2598 bp, Homo sapiens; identical to SEQ ID NO: 12045
  ENST00000613506

SEQ ID NO: 12108 - DNA, 2471 bp, Homo sapiens; identical to SEQ ID NO: 12046
  ENST00000617656

SEQ ID NO: 12109 - DNA, 2392 bp, Homo sapiens; identical to SEQ ID NO: 12047
  ENST00000617772

SEQ ID NO: 12110 - DNA, 2598 bp, Homo sapiens; identical to SEQ ID NO: 12045
  ENST00000618378

SEQ ID NO: 12111 - DNA, 2471 bp, Homo sapiens; identical to SEQ ID NO: 12046
  ENST00000619745

SEQ ID NO: 12112 - DNA, 2392 bp, Homo sapiens; identical to SEQ ID NO: 12047
  ENST00000611239

SEQ ID NO: 12113 - DNA, 2598 bp, Homo sapiens; identical to SEQ ID NO: 12045
  ENST00000619842

SEQ ID NO: 12114 - DNA, 2471 bp, Homo sapiens; identical to SEQ ID NO: 12046
  ENST00000618826

SEQ ID NO: 12115 - DNA, 2392 bp, Homo sapiens; identical to SEQ ID NO: 12047
  ENST00000620311

SEQ ID NO: 12116 - DNA, 2281 bp, Homo sapiens
  ENST00000382582
aacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtatttgca

SEQ ID NO: 12117 - DNA, 4820 bp, Homo sapiens
  ENST00000490319
atagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaatacattttaaaagaaaaacaacaaggagaaagaacaggaagaaagaacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcaggactctctccttgtctggagttccagagagcccccactttctctttctaagctgtgttgtgtgtttcctggtacattctaggttccccaaagataaacatgactaaggattggaaaggaggaaaggccgcgcagattgttaatctgaaagtcaatccccggatttagctctcaaaaatgctttatttttggagaaaagcaatagagtaagacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggtagacctgggggagcagcctctcccgcccccaccccctcagcgtggtgctggcccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggt

SEQ ID NO: 12118 - DNA, 9797 bp, Homo sapiens
  ENST00000585201
ccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgagaaaatgtttaacttcctccaacacaaccagtgcgagaagccccaggaacccgcatgtggaagtgggactggctggcccgtctcagtgaccccagatgctgacactgggaaaatgattctgctgatgaacagaaaaagaggctaaatagagttgctcgatttataataacctcattaatccaaagatttttgttttgtatgtgtttaaataataattaaaacatagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaatacattttaaaagaaaaacaacaaggagaaagaacaggaagaaagaacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcaggactctctccttgtctggagttccagagagcccccactttctctttctaagctgtgttgtgtgtttcctggtacattctaggttccccaaagataaacatgactaaggattggaaaggaggaaaggccgcgcagattgttaatctgaaagtcaatccccggatttagctctcaaaaatgctttatttttggagaaaagcaatagagtaagacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggtagacctgggggagcagcctctcccgcccccaccccctcagcgtggtgctggcccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctggtaaggtaccctctgctcagctccactgagcggggactaagggctcccagaatccccaactaagctgagtacaagggtggctgccgcctctggctcagccgcactgtaccctggacgtgctctgtcccagcaggcgtgcaggggctcaggtggcattgcccacccgcatttacgcgtggatttcctccgagatgcatgtgaagccggaggtgcttgaggaagggctgcgcctgggctggttcaggggccctggagcaggcgactgaccttgactctggggcagggcccagctggagtccaacttgctcatgcccaggggttggggccctcagggagctaaagcaggagtcaagcagacgtgggtgtcggggggagatccctggagccacgggagggaatgcccaggagacctccagggagtggggagtgtcccgtcggctcatgaggacctggaaccagacccaggacgaatgccaggcccgctgtttataagctctgtctctgagacttggttttctcatctgtaaaatggaggtaacccgcccactcagctcacaaaatcgctgtgaaagtaaaaggtagtgacaaacacaaaacgcggctggcaggtgcgcggctcggattccttagataagcagtcacctttattattgttaaacgtcacccagaaaacccttaactcttagacagcggctctcattaagcaaaaggggaggcacatgaagctccaggcagggccgggagggaaccgtgaagccaaaggctctgggagcccccaggcacctgcgtttgcattttcatcctggaggagaccaggcttctggggctgctccccggggtgcagagaggaggggtctttcttggtgtgtaacatactcattgattcagtcacctgacctttgactccatgtattttgttgagtctggatgtgtggtgtgctctgcccagcagcggggatccacatgagcacagacatggtccccccgcgtccttggtgagtgcagaacctctgccgtgagcctcgattctgggaggttctgggaggttctgtggacaacaggcaattcagggcacagcccctgctcttaaggatagccggtcttaggagaagcttttaatatgtgaagtgagcagggagtaactgagctgctaagtaagcagctttatgtcagatgaagtggtaggcaggatccactcctcaacgtaaattctgagttaagaaaaaaattctccaaatattcaagtctcagggccatcatgctgtacattgccgcagttctgggatgtggccacaagagggcggagatgaggctccccggggagcagtgtctgaacccagcactgcagtcaggacggccccgccccacctggccagcacgtcacctgcctctgaatcgcctgggatgcacgcccagacccctatctgcgctccgccacagcctcactgagtcagaatgtccaagggcgaactaggtgttgctagttgtgatgattttgcagacaccgtgctcacctgggaaacacggattcatcccatctggaaaactaattactccactaccagcttaaggactgttagacacaccgggagagctgagtgctggctcagagttgatgggagggcccagatgagtgaggggccccatttagcaaatattgtccttgcaatatatgcaaggcttacaaccagtcactcaaagatgcttgcaaggccagagcttaccaagaccaccctgaggaacagaaagctgcatttagatctgcacatttactgtgtgcaaatataaccagtgtactatacacatgtgtttcctgaaataagttcagtattttccctgaacttttttgtaagaagcttttaaaaattatttaatttctgtagagttcaagggaagcttctatgtatcaaagcaaatttcaaatcatatggttgtaattaaattttactgcataaaaagttcataactggcctactatggccatatggctgaattagttgacttggagcacttccaatagattaataaatcagctcccccagaaatgagggggtctagaggcaggcagatggagaggacagggacttcatagcatttaacatcattttaccatctttccttcctgttctttttggtgctgttggaaatcagtagtgagaggaaaacactcaaatctggaagtctagcgctgtcggtaggaactgggtagaaaaaactatgcatgtccccccatcactcggaaactacatcagaacatcataggagcatcctgtttccatgtgcattagtttccacgaacatacatgtgaatgttttcccacctgtagtgttgctgtggagttgtgagatgtcaaagtggaggcaagagtatctgccttttgcagtaggctctgttcttttcctgtcctgagagaggaggtcagtctaaccctcaccttgtgagttcagccttatactgacctgagcccagggtggatcagatgctgagatcatgtgactccaagttgcaagacacgtaatagagagaagcgtgactgttgcatccatgcaggctctaatcctggctccttcgggctggctgagctttggctcctgagctataaagagaggatgataggaacacctactccaggaggtgctgtgagcacaaaagagaaaacggggaaaaacgggtttcctgcatggtcagtgctcaacaaattgtagtttcaatgataaaaagtaaaaccaatacacccaccattttcaatgtcaaaagggggcatcaagaaagttaagattgtacctcggtaggttaccttgccagaggctgcagggaacttactccatttcagcacagaagcactttgtttcataggacagtggttctaccactttccaggaagtccaaaggctgatctcttggaaatgcagcaaaaggtgaggtgagtgccaacttctgggctactccagagggcagctccaatgccagagatgttcaagttaagccaggatcaaacaggaaaaacccacgctcccgagggagaggctggccctcgaggggcagggccctgcacctgtcagtccccaggccggcaggaggcctccacggtatgtgagaaagctgcctgtcttgggagggaaatctcactagatggttcctgaagcggcttcgcaggctagcatttcataaacgttttcacttgtgaaaacaaaaatcccttgagtgagttgtgtaagcacaacatagaggcttgtttataatgctacgtatgtacttggaaaaccccccaagaagtcagaactgtcaccttggtctgttagctgcgttacttggaaggattcttggcgtctgcgctctggttatttgtgttactgggcagtgtggaagacgtagaattagatgaggacagtgttggttcgttgctgatcggccacggtaaagagcatatttcttttctatcttgctttctgggggctcttcgccaaaattgatcatttcataaaagaggggaaacccaaggagagagactaaactttgaataaaaatttgaatgcaaaaaaagtgcagttctgcttcgtcgatctaagtgacattctgagtgaccaacgcattcctctttctagagggatggccacgcctggctacctccacaccgtgggccacagcacacctgtgcaccatctcaattagctgccaactctcttttaaacatcgaaattatttgtcccccaaacgtgtaaatgcatggttttaagaccccttcaagtcaaagtttgcagacaaagctctctgtgcatttgatttgtctggtgtggcagatgagatggcacataggagggacgtccccagggatggacacgtggctttgctctttgctggcgcgtgtagcaaggggtgtgctagggtcccgccgaaaaagaagttgctcctgttgtcgctggcagttcccctcggctgccctggcacctctagctgacgagaaaaagtgctcattcaaagcaaagcaatggagcggctgcactttcacccacagaagtgcagcgttgttttgcagagcagtggttatgccaggcaccactccctggggcctgggaatccgattccagttctctctcacagaactggaaattcaattagcatttgctgagggaggtcgggagaaatggaatgaaaagaccagctctccggggtgccatttctattagcagatgagagagacacccaatggctcagcatccacccgggaccacagaagaggggatgctggtgtgggaggaccctgcggcactctcgtcctaactcctctctcttccttttcagggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatgg

SEQ ID NO: 12119 - DNA, 2168 bp, Homo sapiens
  ENST00000397875
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacatttgcagcccacggttctctgtgtctttccaggtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaa

SEQ ID NO: 12120 - DNA, 2145 bp, Homo sapiens
  ENST00000397866
gagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaa

SEQ ID NO: 12121 - DNA, 2127 bp, Homo sapiens
  ENST00000397865
aaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatatt

SEQ ID NO: 12122 - DNA, 582 bp, Homo sapiens
  ENST00000527041
gacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaa

SEQ ID NO: 12123 - DNA, 1255 bp, Homo sapiens
  ENST00000359645
agacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctg

SEQ ID NO: 12124 - DNA, 584 bp, Homo sapiens
  ENST00000528160
gagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgc

SEQ ID NO: 12125 - DNA, 552 bp, Homo sapiens
  ENST00000577755
acagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatg

SEQ ID NO: 12126 - DNA, 566 bp, Homo sapiens
  ENST00000527975
tccagaccatccaagaagacagtgcagccacctccgagagcctggatgtgatggcgtcacagaagagaccctcccagaggcacggatccaagtacctggccacagcaagtaccatggaccatgccaggcatggcttcctcccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcag

SEQ ID NO: 12127 - DNA, 584 bp, Homo sapiens
  ENST00000578715
tataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagta

SEQ ID NO: 12128 - DNA, 884 bp, Homo sapiens
  ENST00000397869
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtg

SEQ ID NO: 12129 - DNA, 575 bp, Homo sapiens
  ENST00000354542
agatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaagggaggaagagatagtcgctctggatcacccatggctagacgctgaaaacccacctggttccggaatcctgtcctcagcttcttaatataactgccttaaaactttaatcccacttgcccctgttacctaattagagcagatgacc

SEQ ID NO: 12130 - DNA, 581 bp, Homo sapiens
  ENST00000531144
gacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattaga

SEQ ID NO: 12131 - DNA, 570 bp, Homo sapiens
  ENST00000583474
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggcgtgaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacc

SEQ ID NO: 12132 - DNA, 582 bp, Homo sapiens
  ENST00000533278
gacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccct

SEQ ID NO: 12133 - DNA, 581 bp, Homo sapiens
  ENST00000526111
gacgagctccagaccatccaagaagacagtgcagccacctccgagagcctggatgtgatggcgtcacagaagagaccctcccagaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgccc

SEQ ID NO: 12134 - DNA, 915 bp, Homo sapiens
  ENST00000580402
atgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctga

SEQ ID NO: 12135 - DNA, 1052 bp, Homo sapiens
  ENST00000579129
agcccggggaggcggggccggggagctgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggaggaagagatagtcgctctggatcacccatggctagacgctga

SEQ ID NO: 12136 - DNA, 578 bp, Homo sapiens
  ENST00000578193
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgtagtgagaggaaaacactcaaatctggaagtctagcgctgtcgggaggaagagatagtcg

SEQ ID NO: 12137 - DNA, 565 bp, Homo sapiens
  ENST00000397868
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctggtaaggtaccctctgctcagctccactgagcggggactaagggctcc

SEQ ID NO: 12138 - DNA, 569 bp, Homo sapiens
  ENST00000447114
gctcttccttccatcatccatcatctgcacatgccttcttctctccctgtcgtccttcatcctccaccccccgctcactcctcctcactctgggctcttgccaagccagctctagaggagatttgctggaggactttggggcattgccggcggcgcccacccggactcacgcagcccactctgtgtcccccggcaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgg

SEQ ID NO: 12139 - DNA, 583 bp, Homo sapiens
  ENST00000581179
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggcgtgaagggggccgaaggccagagaccaggatttggctacggaggcagagcgtccgactataaatcggctcacaagggattcaagggagtcgatgcccagggcacgc

SEQ ID NO: 12140 - DNA, 566 bp, Homo sapiens
  ENST00000580473
agaagccagatgattctgcctgtgcaggaatgaagtgcgacccggcgcgcgagggagggaggcctctgcgctttggctccggccgcgcctcctccctgggatccggtctagggctggcgagctccgcggatccctgctcagagcggggctgctgcaccacctgccgcgggtggccaaagcagaaaaaaaagaaaaaaatgggagtggggaatacaaacgtcttattttcttttaaagaatagtgaaactaacagaggagaatctgaaaaaaagagaaacctgggtgaactttcacggacaacctcagaggacaacgaagtgttcggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgc

SEQ ID NO: 12141 - DNA, 570 bp, Homo sapiens
  ENST00000582282
catccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggagccgcaggactctctccttgtctggagttccagagagcccccactttctctttctaagctgtgttgtgtgtttcctgcgtgaagggggccgaaggccagagaccaggatttggctacggaggcagagcgtccgactataaatcggctcacaagggattcaagggagtcgatgccc

SEQ ID NO: 12142 - DNA, 558 bp, Homo sapiens
  ENST00000473302
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgcaggagcccgttaggaaatggacggcggcacagggctcccagtgcagcccacggttctctgtgtctttccaggtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgat

SEQ ID NO: 12143 - DNA, 568 bp, Homo sapiens
  ENST00000483025
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggagagccgcacactgagtcggtgatagaaatctctccccagcaagtcgcacacccaaacccgctgctgccagcccgtagctgccccaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggag

SEQ ID NO: 12144 - DNA, 580 bp, Homo sapiens
  ENST00000493623
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgacagaagtggggaggctgggcacccgggtgcttctggcagctgatggatgctagccaccctcagcaggcaggagcccgttaggaaatggacggcggcacagggctcccagtgcagcccacggttctctgtgtctttccaggtgacgcctcgcacaccacccccgtcgcagggaaaggggagaggactgtccctgagcagatttagctggggggccgaaggccagagaccaggatttggctacggaggcag

SEQ ID NO: 12145 - DNA, 580 bp, Homo sapiens
  ENST00000585216
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatt

SEQ ID NO: 12146 - DNA, 1290 bp, Homo sapiens
  ENST00000484548
agacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgagaaaatgtttaacttcctccaacacaaccagtgcgagaagccccaggaacccgcatgtggaagtgggactggctggcccgtctcagtgaccccagatgctgacactgggaaaatgattctgctgatgaacagaaaaagaggctaaatagagttgctcgatttataataacctcattaatccaaagatttttgttttgtatgtgtttaaataataattaaaacatagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaata

SEQ ID NO: 12147 - DNA, 400 bp, Homo sapiens
  ENST00000583118
ccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaa

SEQ ID NO: 12148 - DNA, 561 bp, Homo sapiens
  ENST00000578873
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcgg

SEQ ID NO: 12149 - DNA, 769 bp, Homo sapiens
  ENST00000467108
tccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggtaagaccttggaatgttttgattgatcatcacttttctgatagaccttctctaaaatcccataatgtaccaaagagagagttaggctccgagctaccagaatccatcccaaaacgtgttgccaggcagctcccaagtagaacaggtcggcagatccatgcacccctcctgtccctcccgcacctgcacagccgctgtggccctgagcctgcggcccccctcggagctccgggtggaacctgtttttaccacctcagctccactgtgctttgactgtgtttcctgttgattgaaaggactttcccttcactgaccaccatgtcattatttctctgtcttcctcatgcaggggagaggactgtccctgagcagatttagctgggtaggtgacgaacgcactt

SEQ ID NO: 12150 - DNA, 569 bp, Homo sapiens
  ENST00000459948
agctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtctatacttcttcaccaactaggacagaagtggggaggctgggcacccgggtgcttctggcagctgatggatgctagccaccctcagcaggcaggagcccgttaggaaatggacggcggcacagggctcccagtgcagcccacggttctctgtgtctttccaggtgacgcctcgcacaccacccccgtcgcagggaaaggggagaggactgtccctgagcagatttagctggg

SEQ ID NO: 12151 - DNA, 559 bp, Homo sapiens
  ENST00000482445
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtaagtgacgatcgatgggaagaggtagcaactgtgagggggaggaggggtgctggccactgctgtcatccacacaggacgttcgtacgctcgggggtggcaccggggtcatcatcagggtgaggccggccggggaactcccccctcgcacctgatcgcgagttccaggcaagcgcttcccgactgtatctgccacggattgcaccgtgcgctccgtgcgttctccagag

SEQ ID NO: 12152 - DNA, 875 bp, Homo sapiens
  ENST00000498683
caattctaaatgccccacttctttcatgcatgaattgcaaaaagatgtggcaagttttgtttctaccaagaaaactaaaaacaccttttgtcaaataaatgctccttgcatatttaacttatgcaccagtggccttttaaacagtcaatgtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccg

SEQ ID NO: 12153 - DNA, 583 bp, Homo sapiens
  ENST00000583266
agaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaagacccttgtgctcctggcctgacttggaggacactgtccacccctcagccttggcgcccatggaggcttctggaaagacctgccctgcctctgaatccaccatcacccagcacactggcgtttaggaagcaaagcattttgtgccatgggaaagcacaggaggaagaaccaaaaatgcttggctcaggtctcatggcactgcgtcatagccgtggacctggggcaggtgtctgtcttctctgagcttccttccctctcctgtgaaacagcaatggtggcaaaagcgtcacctgtcctgcagatgctttggaacgttgtgctgatcaagcaagaaaagcaatgcaaaggccccacaggagc

SEQ ID NO: 12154 - DNA, 4800 bp, Homo sapiens
  ENST00000397863
tcctttcgcgtccacctgagcccccccgttttggaaggtggagtggggcttgggaaaaggttcaagcgtctttggggacccccgtgcgactctggctggaaacaggcgagctctggttccttgttccgttttccaattgcaacaaccctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 12155 - DNA, 4844 bp, Homo sapiens
  ENST00000397860
cgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 12156 - DNA, 563 bp, Homo sapiens
  ENST00000581878
ttgcattcccaccggcggtgtgtgagtgattcaggaccttcccagcctgggcagcatttgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggc

SEQ ID NO: 12157 - DNA, 913 bp, Homo sapiens
  ENST00000487778
tgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacggacatcgcccagagcagcaacatcctgcggaaaagagtgtcagtggcatcttttgttatgcagaggagatggaatcctcccaggtgactgatagctgagagggagggaaactatcaggagagccaagaagagagatgggttccaggaggagaaagttgtccacaacaggaagagctgccacagggctcccctctgcctggctcctgcagaccccatcttcacagaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagagg

SEQ ID NO: 12158 - DNA, 531 bp, Homo sapiens
  ENST00000490754
caggctgctccaggtcccctggaagctccagatccagatccctgactgggggtgtaggtcaggaggaacgcggggcctcattctgggactcccccaacctcctcctcttccaccatcaggaggctgagaatccagagaaagatctctgaccactaaatctgtgtgcagcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctga

SEQ ID NO: 12159 - DNA, 578 bp, Homo sapiens
  ENST00000495162
gtgtttgcctccagccttccctagattcccacgccggcctcaccctacagcgctgcgcgactgctttgcagaagccagatgattctgcctgtgcaggaatgaagtgcgacccggcgcgcgagggagggaggcctctgcgctttggctccggccgcgcctcctccctgggatccggtctagggctggcgagctccgcggatccctgctcagagcggggctgctgcaccacctgccgcgggtggccaaagcagaaaaaaaagaaaaaaatgggagtggggaatacaaacgtcttattttcttttaaagaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaa

SEQ ID NO: 12160 - DNA, 889 bp, Homo sapiens
  ENST00000497479
caggctgctccaggtcccctggaagctccagatccagatccctgactgggggtgtaggtcaggaggaacgcggggcctcattctgggactcccccaacctcctcctcttccaccatcaggaggctgagaatccagagaaagatctctgaccactaaatctgtgtgcagcctctgaagagccaatccattcaggatgggaaaccacgcaggcaaacgagaattaaatgccgagaaggccagtacggacatcgcccagagcagcaacatcctgcggaaaagagtgtcagtggcatcttttgttatgcagaggagatggaatcctcccaggtgactgatagctgagagggagggaaactatcaggagagccaagaagagagatgggttccaggaggagaaagttgtccacaacaggaagagctgccacagggctcccctctgcctggctcctgcagaccccatcttcacagaaaggaaagccagatcactcagaaagtcacttccttccggtcacccaaacccacacctggattgctgtgacacggctgtcatgccattgagcgccaaattccctgggaaattcttcctttctgatctgactgcagtgtgctggcaattgacagatctgtacgtgtaaaatttctactttatagaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttccc

SEQ ID NO: 12161 - DNA, 876 bp, Homo sapiens
  ENST00000493247
ccctacagcgctgcgcgactgctttgcagaagccagatgattctgcctgtgcaggaatgaagtgcgacccggcgcgcgagggagggaggcctctgcgctttggctccggccgcgcctcctccctgggatccggtctagggctggcgagctccgcggatccctgctcagagcggggctgctgcaccacctgccgcgggtggccaaagcagaaaaaaaagaaaaaaatgggagtggggaatacaaacgtcttattttcttttaaagaatagtgaaactaacagaggagaatctgaaaaaaagagaaacctgggtgaactttcacggacaacctcagaggacaacgaagtgttcggtaggtgacgcagatatcggcaacatggcgccacatggtgacagcgtgcacctgcactctcactcggggaagcctttgatttttttattgcatgggtgatccatggatctgtctgtactcattactaaaacatagaggctgggatcattgcttcatgtctgtaatcgcacacttcatggggtctatgcaagaggatcgcttgagcccaggagctcaagaccagcccgggcaacacaatgagacctcgtctctacaaaaaataaaataaataaattagccaggtgtggtggcatgcacccgtggccccagatacttgggaggctgaagtgagaggatcacttgggcccaggaggtcgaggctgcagtgagctatgattgctccactgcactccaggctgggcaacagagcaagacgctgtctaaaaaaaattaaaatgtcggctgtgtagatacgtggcagatacagccccttcctcccctcctgcaatcccttcccatctcggttttgtttttgctcgcatgcc

SEQ ID NO: 12162 - DNA, 573 bp, Homo sapiens
  ENST00000583798
ctactttttaattggattgtttggttttaacaactgagttttcctaattctttatattttctagatgctggccttaccactcggtgattattttctaccactttatcttgttttttcaccctcttcacagagtcctttgcagaaagttttacattttgttgaattcaagtttattaattttaccttttttggattttgatttttggtgtgaagtctaagtcttcacctagcctgaggttcccgaagattttctccttttttccctacaaattttatagtttcacattttatacttaagcctattttccattttgagttaatttttgtatgaggtgtgaggtttaggttgaggcttatttgttttggtttggtttgggttttgccaacgaatgtccaatagctccgggactattagttgaaaagcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagagga

SEQ ID NO: 12163 - DNA, 2772 bp, Homo sapiens
  ENST00000355994
tgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggt

SEQ ID NO: 12164 - DNA, 3313 bp, Homo sapiens
  ENST00000264036
ctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 12165 - DNA, 3164 bp, Homo sapiens
  ENST00000528533
acttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctgggtgagggctgcatccctgcaggggatggcaggggcaggcccaggcacgggcagtaacttgcgcttctcctaacacccctccctctgcctcctagtcaatttaaccaccctcacaccagactccaacacaaccactggcctcagcacttccactgccagtcctcataccagagccaacagcacctccacaggtaagccaggcctggcaagagaacagggctgtgccagggcatcctttctgccctgtccctccccagagagccctgtccagaaaggtgagtagcagccccatcttgtcggccctggactggctgggccaacgatggtgacgaagtggcctggggcagggagtgacgaggagtgtctttgtggcgcagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaa

SEQ ID NO: 12166 - DNA, 4865 bp, Homo sapiens
  ENST00000525586
atctccagggtttgctggctcaccctccacctcccccagcgagcaaaggggtggccccgctgggcaacagacctctacccaaatccaggcccctatttggcactccctggtggaggcgcgccagcagatgtggaccccttttctgaggccaggctgctggggtcagagtgaggcaagagcacctccccctccctagagccttagttcaagaggccagaagacccagggagaagccggcgttttgggagaaggggagctgcagagctccccacccaagcaggtgaggggaaactgagttccagggtaggctccagagtgaagagggaagaaacatgattctcaaggcccaggtctggacaagtgtgaacaccttgggcctgcgaattcagccccctccttcctttctctggtcaaaggctagacttgcaggagcttgcgtttgaagggacagcccagaaggcatcgtctgcactccccatacaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgtgagtagccctttctcccaaaagccacccttgggccaggtgtggtagctcacacctgtaatctcggtgctttgggaggccaaggcaggaggatctctggaggtgaggagttcaggaccaccttggacaacatagggtgaccctgtctctacagaaaataaaaaaattagccaggcatggtggtgtgtgcctgtggtcccagatacttgggaggctgaggcaggaggatcatatgagcccaggaaatgaaggctgcagtgagctaggattgcaccaccacactccggcctgggtgacagagcgagaccccatctcttaaaaagagctgtccctatggtactacacaggaactgccttatattttcattaagcttttaacttaaaaaaattatacaaatggtacttgaaaatattttcatgagaatttaaactgacaaaaaatctagaagtttcttcttgcctgagaccccccctcccagaaataatctctgctatcagggtgtgttctttcaagcctatttctatgtatttgctcatatatagaaatatttctagaatgatataggcttctgtgttttattatctaaatcagtcattcttaaccaggggtgattttgtaccccctcctcctaggagatacttggcaatgtctggagatatttttggttgtcacacatagagggggtgctactgccatctagtaggtagagagaccaaggatgttgctaacatcctatagggcacaggacagcccccacaataaagaatcaacgtggcctaaaacatcagtagtgctggctgggctcacgcctgtaatcccagcacttttggaggccaaggtgggcggatcacctgaggtcgggagttcaagaccagcctgtccaacacggagaaaccccatctctactgaaaatacaaaagtagccgggcgtggtggcgcatgtctgtaatcccagctactcaggaggctgaggcaggagaatcacttgaagccgggagggaggtggaggttgcggtgagccgagattgtaccactgcactccagcctgggcaacaagagtgaaactctgtctgaaaaaaaaaaaaaaaaaattatcagtagtgctgagaaaccctggtctaagtggtggtgtatggtatacattgttagacaatttcttttatacaatgtttctgggtcagtctatttagatcaactgatcgttttgcttactgccaagttttccatactacgcatagcaggtagtcgagttcaccattccccatttagtggacatctagacggctgctcgtttttatcattgcagcattctttgcacacatccttggatatgagcagacatgaaaatgtttttctagggttgacactgagcagtaaaagtgctgggttgaagggtttccagcttgcatttgtacctggccttctacaggggacagggggctatttagatggtcccctgccaaccccagtggacaaccctagggtggggctggaggtggggctgaggctgagtcttcctccccttcctccctgcccaggggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacaggtaagccaggcctggcaagagaacagggctgtgccagggcatcctttctgccctgtccctccccagagagccctgtccagaaaggtgagtagcagccccatcttgtcggccctggactggctgggccaacgatggtgacgaagtggcctggggcagggagtgacgaggagtgtctttgtggcgcagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgagg

SEQ ID NO: 12167 - DNA, 206 bp, Homo sapiens
  ENST00000524940
tcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatggagagaaatacatcgatctgaggcatta

SEQ ID NO: 12168 - DNA, 722 bp, Homo sapiens
  ENST00000528976
ccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctcct

SEQ ID NO: 12169 - DNA, 541 bp, Homo sapiens
  ENST00000530706
acttggctctcgccctccggccgggaagcatggggcttcccaggctggtctgcgccttcttgctcgccgcctgctgctgctgtcctcgcgtcgcgggtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctgg

SEQ ID NO: 12170 - DNA, 563 bp, Homo sapiens
  ENST00000529257
ttctagctctgggaggagtcaggggtctgaggctctgggttggagaccccaccttccacctgccctccttgtccgagagccaaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaag

SEQ ID NO: 12171 - DNA, 757 bp, Homo sapiens
  ENST00000529295
agagtatcccgggagcagcactcggaaggcggggaggaggctgcttctgggaacgagaaggggtggagctcagcctttcggggtgctggggggtgggtggtccctgaggtgctcactctgggggcccgcaattgaagccgggcaggaggcgcagctggggcgcatcctcaaagcctgaattccgcgcccgcctgttgctggaaaaggcagcttccttcgctggagggggtgcgccgacccaccccttcccccttctgcctgggcatcacgccaggctggaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctg

SEQ ID NO: 12172 - DNA, 562 bp, Homo sapiens
  ENST00000530006
cttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtgagatgtgtggcaggtgggctgggcagctggtgcgcagccgctgagatggggcttgaaggg

SEQ ID NO: 12173 - DNA, 588 bp, Homo sapiens
  ENST00000530937
acttggctctcgccctccggccgggaagcatggggcttcccaggctggtctgcgccttcttgctcgccgcctgctgctgctgtcctcgcgtcgcggcctcagctggagctgttcggtgctcagtctctgctcaatctctgcttggctccaaggacctgggatctcctggacggggagagggctggcccaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcct

SEQ ID NO: 12174 - DNA, 478 bp, Homo sapiens
  ENST00000528502
acttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaa

SEQ ID NO: 12175 - DNA, 563 bp, Homo sapiens
  ENST00000529686
acttggctctcgccctccggccgggaagcatggggcttcccaggctggtctgcgccttcttgctcgccgcctgctgctgctgtcctcgcgtcgcggctctgggaggagtcaggggtctgaggctctgggttggagaccccaccttccacctgccctccttgtccgagagccaaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagt

SEQ ID NO: 12176 - DNA, 555 bp, Homo sapiens
  ENST00000526190
acttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtgagtgcttgggctcctgcaagagcagcccggggagggagactctgcccctcttgtagcccaggacccttctcctcctctgtgtctcctcccattaggtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggt

SEQ ID NO: 12177 - DNA, 567 bp, Homo sapiens
  ENST00000525555
acttggctctcgccctccggccgggaagcatggggcttcccaggctggtctgcgccttcttgctcgccgcctgctgctgctgtcctcgcgtcgcgggctactgcctcccaggctgactttatttctggggaaagggctaaatcgggctccacagttgcagccggtccagctccaccctgccctgctcttctagctctgggaggagtcaggggtctgaggctctgggttggagaccccaccttccacctgccctccttgtccgagagccaaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccct

SEQ ID NO: 12178 - DNA, 569 bp, Homo sapiens
  ENST00000534522
ctttcaccgcagagacaaatcctccacccccacctggcttcactctcctccagcggaagaagaattcagaactgactgtccttggtggtgaggggaaactgagttccagggtaggctccagagtgaagagggaagaaacatgattctcaaggcccaggtctggacaagtgtgaacaccttgggcctgcgaattcagccccctccttcctttctctggtcaaaggctagacttgcaggagcttgcgtttgaagggacagcccagaaggcatcgtctgcactccccatacaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgt

SEQ ID NO: 12179 - DNA, 909 bp, Homo sapiens
  ENST00000530144
aggtgcaggctgggggcagaggagagggaaggggattaggtgctggggccggggaaccgagacccagggtgtcaccgctgacagcagcggggcccgcagagctgcagggagacagagccgcctccccgcggcgccgacgctgccatctagctagagggccccactctttctttaaccagaggtcacagcctcattgcctacccaggaggcagccccgagacgccccctgcggcctgggttttctccaccctgtccccgcgcccaccccagctctgccatccccggctgcaccgctttgtaaaggggacggctggtcagaccgaatcactgcgcgggctcgcgctgggtcgggcctggagactggatctggggcttccggagagccccaggctccccgcgcgcccatccacccgcagccgcctgagcatttatggtgaggggaaactgagttccagggtaggctccagagtgaagagggaagaaacatgattctcaaggcccaggtctggacaagtgtgaacaccttgggcctgcgaattcagccccctccttcctttctctggtcaaaggctagacttgcaggagcttgcgtttgaagggacagcccagaaggcatcgtctgcactccccatacaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatct

SEQ ID NO: 12180 - DNA, 574 bp, Homo sapiens
  ENST00000526992
acctagggtggggtccgcgggtgtgtgcggagtgttcatggaggtgctgctgagggagcatgagaccggaacttccgccagagttagcccgctggggagtgagggcagggattttggagggcagaggatagagcagtggtgtcttcccctggcggtggtgacacaaaagggcctgtgtgccccagcctggcacatgctttgcattcccacactctgagctcacccggagaggagggggcctggaaggaaaggggccttcctcttggccccgagcctaggttgcccctttctgcccctctaccagcctcagctggagctgttcggtgctcagtctctgctcaatctctgcttggctccaaggacctgggatctcctggacggggagagggctggcccaggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggc

SEQ ID NO: 12181 - DNA, 8257 bp, Homo sapiens
  ENST00000302475
agaaaccacttacaactccagacgattcgaaggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggcgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcatttggtcaaagttagttcctgtgattttttttttttttttttgagatggagttttgctcgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttctctgagaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactaaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtctttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcatccatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaaaatagctactttgcgttatttgatatagaattgttttttaaaaactccatttatttatacagagacatttataatattttacaaacattcttatattctgaataaatatttctaattccacagtgta

SEQ ID NO: 12182 - DNA, 3844 bp, Homo sapiens
  ENST00000515367
ttttctatatataatatctgcactcaacagatattctctgtttttctgtatttttaaagggaaattggaaactatgggtagagatagagacctcttttgagggatttgggtttagtaaaaagcccgtctaggggggcttccctggcatgctgaagcataggaagatgctgcagtgtgctcctctactgtgatctgatgcagagttgccacttctagtcacactccacaaaggaagaatgtgctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggcgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgct

SEQ ID NO: 12183 - DNA, 3476 bp, Homo sapiens
  ENST00000408903
atgactccgggcggtcggagaaggtctgccgggagtacacctgccctctgcctgaagcgtccccaagtgtcccgggcccgcgtcgttgccggatgcacaatgctgacacccttcccgggggcttccagtgtattctgcctcctcttgtgttcccgttgccacccttagctccctgactcttccagccaccttcccctcctccctcttccctgaggtgcctcctcgggcgattccagagcgcccatcttcccagtccgggcaaaacccggagaggtggaatccctcgcccggagcgccccggcggccactgggcatgctccgttgtcaggcaagttcggggctgcaggcagcttgcgcgccgcgcggattccagctgcggtcgcgcgtactcctcctcccaagtagggagcgggcgcatgatggcggccgcggcggcagcggctgcggggagctccagcagcggcggcggcggcggcggcagcggcagcagcagcagcagcagcgacacgtccagcaccggcgaggaggagaggatgcggcgcctcttccagacgtgcgacggcgacggggacggatacatcagcagaaatgacttgctaatggtctgtcgccagctgaatatggaagagtctgtggctgagatcatgaaccagttgggagcagatgaaaatgggaagatttcctttcaggatttcacaagatgccgcatgcagcttgttcgagaaattaggaaggaggaagtagatctttctgcaaagtcagacaactcctgtacaaagaagctgagggatagaattgcttcctggcccacgagcagtgacaacagtttgggtgccttatcagcagccagggagagctgggaatacgactctggtgccagggacctccagagcccggatgtgcagagccagtcagccctccagaagctgctcgagtatggcggaagctctttgcatcagcaggctgctctccacaaactgctcacacagtccccgcacattggcaactctgtaggaggaagctatctagagctggccaacacactccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaa

SEQ ID NO: 12184 - DNA, 664 bp, Homo sapiens
  ENST00000624689
cgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggtgatatgatccaaaatcccccatagatgcctgaaaccacaggtaatactgaacccttatatattctacgttttcccctatacatacatacctgtgttgaagtttaatttataaattaggcacagtaaaagattaacaactaataaaatattaatagaacaatta

SEQ ID NO: 12185 - DNA, 2855 bp, Homo sapiens
  ENST00000514701
acaactccagacgattcgaaggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggtagggccggagtggcttggggacacccttaggctcagtgactgcccagtgactgcccagtgaccactggccacacctcaccgccctgctgcctcagttcttgtatttgcataggaaatgcaggccattcgtaggtatctaagaaggtgacattttgagtgtaatgaaaccaggtctacattttagaaataccaaatctcactttatgtaatagttg

SEQ ID NO: 12186 - DNA, 757 bp, Homo sapiens
  ENST00000502648
tcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtgagcatgctgcatccataatggtcaggcccttcctgggcatggggctgagagaggctggtgtatagcaccaggggcaccgtgagaattttgtggcatttgtaattttgggaatcactgtctctttcctgttatgaagtccttcttgaaagtagttcgaaattgctaaggtatagaggtaagatttaaaaaaaaaaagcaaacacttttctctggaatcttaaatctgactggttgat

SEQ ID NO: 12187 - DNA, 837 bp, Homo sapiens
  ENST00000505604
ttcttactaaagaaactcaagatgtggctgctttgagtgaaagacaagagaattcagaaaatgaccatcatctgaaactctttaataaaaagagctttgcattggctccaagtctcagaggcagtgcctgtgaggttaggctggctggtgttgaactttgaaatgtcaggctccattgccatcccattacctgaatgagtccctcatggtaagcaaaacagacagcatttgttgccctgtgtaacgcattttgtcttcattcactcacagacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtgagcatgctgcatccataatggtcaggcccttcctgggcatggggctgagagaggctggtgtatagcaccaggggcaccgtgagaattttgtggcatttgtaattttgggaatcactgtctctttcctgttatgaagtccttcttgaaagtagttcgaaattgctaaggtatagaggtaagatttaaaaaaaaa

SEQ ID NO: 12188 - DNA, 857 bp, Homo sapiens
  ENST00000506605
ggcgagaccaaccccggactgtgcctccaccacacccatccccacacctcttgggcaaggaggaccagagcacatgtcaagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtgag

SEQ ID NO: 12189 - DNA, 840 bp, Homo sapiens
  ENST00000511847
tcagatctgcctaactgcgttgaacagagacgagagaacagagacttgatgaaatgagcatcagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtgag

SEQ ID NO: 12190 - DNA, 744 bp, Homo sapiens
  ENST00000511242
cgggcggtcggagaaggtctgccgggagtacacctgccctctgcctgaagcgtccccaagtgtcccgggcccgcgtcgttgccggatgcacaatgctgacacccttcccgggggcttccagtgtattctgcctcctcttgtgttcccgttgccacccttagctccctgactcttccagccaccttcccctcctccctcttccctgaggtgcctcctcgggcgattccagagcgcccatcttcccagtccgggcaaaacccggagaggtggaatccctcgcccggagcgccccggcggccactgggcatgctccgttgtcaggcaagttcggggctgcaggcagcttgcgcgccgcgcggattccagctgcggtcgcgcgtactcctcctcccaagtagggagcgggcgcatgatggcggccgcggcggcagcggctgcggggagctccagcagcggcggcggcggcggcggcagcggcagcagcagcagcagcagcgacacgtccagcaccggcgaggaggagaggatgcggcgcctcttccagacgtgcgacggcgacggggacggatacatcagcaggttatgcaccagaaaggagaagaatggagaggcaaagactgattgaccccactcatggtgcctgcccatcctgtggatcctccatcttttgaaaaagagctctgaatcttgtcatacttaaaaacttttggaatctaaaagtaggcacatgacagaaaaatccta

SEQ ID NO: 12191 - DNA, 3932 bp, Homo sapiens
  ENST00000369026
tccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaata

SEQ ID NO: 12192 - DNA, 1099 bp, Homo sapiens
  ENST00000464132
ccaagggtgggttggaaaccgaaacgagtcagtgttgaaacgtgtctcatcctattcctgaagccagaatattctggccatgagtcattgtttccgcccatcttgattcttttggaaatggcagctcttgttcaaagaccggaaagggtgggatgtcaatttcaagtggggtcaacctgagttctgtaaatcccagtagcgattttcccgccgcgggtgggcaggcgaatcttgcgccggtttagacaaaggaggccgtgaggacctgcatgcttttctttctcaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatg

SEQ ID NO: 12193 - DNA, 1110 bp, Homo sapiens
  ENST00000307940
atgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaattt

SEQ ID NO: 12194 - DNA, 3626 bp, Homo sapiens
  ENST00000620947
gcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacaggg

SEQ ID NO: 12195 - DNA, 1905 bp, Homo sapiens
  ENST00000514040
aggaaatgcattttgtgagaagaataattgtatttgagtgtctctgtaaaaatcaggaagtcttttagcagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtgctgcaattctgtcttgagagctgcctgacttgccttcattttgagatctgtgatgtaaatatttcttaagagactgaatgtcactcaaacatctacttggactgctaactattatagatattgtgaactactaaatatattcctttagtatcttttagtgagtaaattcactgagtcattatttatattcataaactattactgacattcgttgtgataattcataagaaatgcgtatttgtgcttttaaatttttccccacttatcaaaaagaacataatagtacttctcattcattctggtactgttccagactcaaactgattgattgattgaatctcccaactcagattatcctagtgcatatagaatgttcaaaaactggaattcctacagaacctatcaatcaatcaatcagtttttgaacattctatatgcactaggataatctgagttgggagattcttaaaaggactctgtgatatatttatcgaataccaactgtatgaccctgttatagacaacggtcaaaccaatgattgtatactaaaatcaaatctggagttgaagtacagtgagagccaaatttaattgatacatttctaaaattatcttttataaaatttttattctgcatttaaaagtgaagaaaaactcagaagtaaatgcttatctagggaccacaggagctttttttccactttgatctcatatctaaggtctcctatgctcaaagtagtctacatttgtattaatgttattcaaaggcagtaatttcagcgaataaacttgttaaatgggcctaaatgtttataatgttgactaagcattaagaacaaacaaaaaggtataaggcagttatacctttttgctccagaaatacaagtaaagacagctaccattatacttcttgaaaaacgtctcaggtattgctaaattaatacttgcttaaattcttgggctttaaatgaatagcgtgatttcacactctagtgtgagtgagtgtacagatgatgtctattcgttggtttgattagggtatctagaatcagccttttctaattgctcagtaaagtatgaattaaaaccacatagaaaataatgtggtaaattctttcttacaatagtgtcattcctttcaattataattctttttcctgggatgattggtgtaactcactgaaagaaaacaaaacatttttttttcttttttttttggtgaaaatgttaccctctggtacctcagtttcttttatatagtggcaatttgaatagaggcagtcacataagatttacttcagctgaatggctaaaatttgagaaatactattgaaaaatctcattaaaaaatagtatgcaaataaaaactatcaaatgtccaaagcaatcatacaatgtagaaactaagagcaccatgaaaggtttcctggaacttaatgattctatctgtgcttttcaaagga

SEQ ID NO: 12196 - DNA, 5396 bp, Homo sapiens
  ENST00000515393
atggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaacctgctttctcattagattactgaaatgctttaattcatactatgattttgttattagtgtgaattttaatgtagagaattcagtgtgctaagtgatatgccagtgtttcactacattcatttattaaaaaaaatcattcttgattatgcatgaaaacctgttttgtaaaataaaataaactgcttgggggtggtggttgcctttatcaatgtttcactattatcatagaatctatacttaaaaattgcattcccaagactcttaaagtagtttttatatctcactccctggtatactaagggagcataactctggagaaaaaataatttggttggttgagaatgtcttacttccctgacttggtaggggactacactcagttgaaattgcagcagacaatgctttgcactactttattaataataaacttggatggggtaaaagtgggggttatactggaaaaactatagaaaagctaaaagaaatgtatatttcactctaaaggaagattctttaacaataaatgtaatctcattgaagctgatttttaaagtatttttattttagagataagttgttaaatactatttcttataatagaactattttgatctgtttatatactatgcttgaatgtcaattaaattccctttctacagaaaggctttgacctcaacatgctttatttaatgtatcatgtttaaaatgacatgcttctgtctgcataccatcactgtttgttgctaaaaacataatgttccatgaacatgatgttactacagaaagtttattgatgagataactgtttgaaataactttcaattataccttatgtgagacttttatgttctgtgctgacaatgtgtactcaaatgtctataagcctgatattctacaacctcagatgtatctagtggatagtaaccattaacagatgactaatttgtttcactgtatcaaatttcagatgtttagttcaatggtaatgctgactacacattcactgtattaaatacaaaagaaaataatctttcccacgtataatcagcactccttttttttttttttttggtggttcagagattgatgagggattgtgtgcatattcttaaaaactatatgtcacttggagaaaaacagatttggtttaaacaaataagacctttttcctgaaactctgactcttatatgaaaatacctctggaggggtgagcaaccaatgacattaacagaggaataagaactagcttgaggcacaaaagtgatattcagggaaatcttcattgcttttagaaactactacattcacaggctgaaaacagaatatgtatagttaaaattttaactatttatttctttccccttctcacatagctgcaattctgtcttgagagctgcctgacttgccttcattttgagatctgtgatgtaaatatttcttaagagactgaatgtcactcaaacatctacttggactg

SEQ ID NO: 12197 - DNA, 3159 bp, Homo sapiens
  ENST00000429576
attccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaa

SEQ ID NO: 12198 - DNA, 2629 bp, Homo sapiens
  ENST00000505078
acacactctgctacattgaaactgctccctgaatcttttcctccggtaaattgtgcttcctgggaaactaagggtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcag

SEQ ID NO: 12199 - DNA, 2337 bp, Homo sapiens
  ENST00000312216
atgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctag

SEQ ID NO: 12200 - DNA, 2225 bp, Homo sapiens
  ENST00000509850
aagagacaggttggttaaaaatcacaacagtataaagatttaggtccacctgcaaaatgtatttttcttatctggcacactaggcttcatcatactataaacatgttagttgtgcagattcttcatatatcaaagtgtagctttgtctagatatccctctgatttattttcaccatttatatacaaacagaggcatttcaatccatatggtgcatttaggaaaatatgctttttttgctgttgtattttatcttgtggaatatatgtaaacatggtactatacatggctgcctgtttaagaggtcacctttagcattcgggaaaagggtccttggtacttgcaggttccttaggaacaaaaggatccttttatgtgtactaaacaagaatgtttctataaagacctacatcaaaggtgatttttttcggtcctaatttttaatgcaactatgctgcatgccaacgattcttatgcacctgggctccatttaggagactgtcagttgcagcattcttctttttttctttctttcctgacaaaattcttggtttggaaaacaattttcagtctctaggatctactataacattaataatatataaactagacggggtagaagaagaattctctacttacccctcacctgcttacacatacacctaagactgctaaaacaaatcaaatgcaaagaaccaaaatgagtcttagcttcggaaagcatgtgcttacactgaaagcaaaattcttttcaaggcttttgaagaaatatgttggaataaagtgagttcaagtctgatgactccaagccctccgcttttaagatactttgtccctattctttttggcccaacttgccatatattgaggaagccctcttaccccttattatcactataattaccctttcagtctgggtgagaggtgggggaaatggtaattattttttcctttcctaatttctataattcaaagatattcaatttagacagcactttcattatataagggaagaataatttccactatgttcttgcttcctattgtatgttcatctttcatttcttcctgatagttaaaacagatgctgctttatagaaaaaattagggtagaatgtcatgtcgtggcagtttattaactctaatctacctagggtcagacctgccttggcttgtggagtcatctctgttgcaataggtggtggtgaatgccctgttctcccaggtttacagaaactggagcccagggcagacatctagctgtgtaacctgcagtgccctcactgactagctgtcttaaaagtaactttgcagaatgtgtttgggcctcttgtttcattaaacaaaataaaacaagaacagtattcctttagtggtaggtgattgctgaaatattagccagaaatttaagacataggtcttacatgaggagatggaccaaaatcaagattccagaagtttattctgcatgaactccctgaagaggagccaagatgctccagtgtatggctcagtttttaccagtttgttgatttcatgtaaaggtgtttatttatttatttatttttacaaagttgggggcaaatcttttcatttcaggtttgaaaaaaataaacatcatgtgtcttctaaacatttagctggcattaacagcagcacacacccccacctccaaaaaggtgcatcttttggaaaaggggaaaccaaataagttagacatcttgccttaacaatcttaacccaaaaagtaggaaagcaagtttcatcataaatgaaacactaaagcaaggcttctaagtagactgtaacacagggggaaaaaaaaccaagatattgctaattaacccccagggcagctcctttatttcccacatagaaagcctttcctgcttggaagaagctactaaggtacaagtaaaaaaagcagttgagctggaaaggaggaagaaatgaaggagaaaaagaggaagagggggaaaaaactgggtgtattggttcattgagtcaaggcatacaagttagatcttcaaattactacaacacttttgtcagaaatgtgctttgtttaactccaactttgtttcaggcatcaataaatttacaaaaaagcttcggagtccatatgcaattgataacaatgaactacttgacttcctttccagagtcccttcagatgtacaagtggtgcaataccaagaactgaaaccagatccttctcatagcccat

SEQ ID NO: 12201 - DNA, 2214 bp, Homo sapiens
  ENST00000508509
attccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactact

SEQ ID NO: 12202 - DNA, 1751 bp, Homo sapiens
  ENST00000512425
ctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactg

SEQ ID NO: 12203 - DNA, 2158 bp, Homo sapiens
  ENST00000505208
gcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggccttgtatgggactttcattaatgtctgagcacatggaacaaagagtgtctacgtccctttgtgttgtaagttaccagaaagttaggcagcctgcttcccatagacgtgttgttgtctccctaaagaaagcaattgtcattatcgttaagttttagaaaaaaaatctctctctctctgtctctctcagtattctttttgtagctctttcttataataaatatatggtggtactattaag

SEQ ID NO: 12204 - DNA, 2350 bp, Homo sapiens
  ENST00000506568
actctgaaagatcctcattatcctgaccatgatcttggaatcattttgctctcagtcatccttacccctaaagaaggagagtccagggatgtggaactttcagaaaatgaagtggttggatcttatttctctgtgaagtctctcttttggaggtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtatgatcatactgtattacttacattgttattcattaaattcagtaatcatagctgcatgtttctgtggctatagtaacagttatgttgatgtggccattttaaaactcctattttaagacttgactggacagatttgccgtgggcaggaacctgatggattgtacaaggtctgagtctaagaatacattttcccccctcagatttccggaacgcaagacatctcagccaatgtatcattttctctgtgacagttaaaaagtaaaattttacatattgcataattccaaaccccaataggacagccaagaaaagtcctccatgtgaaaaataataatagtaataatctcgaccattctcaatttgattttatctgtcctatagttaatttttttcaagatatgaaaatcattggtagtagaatgctaccaatgctacttggtaatgctttaacatgtgattcaactggaagtggatgtgacctatttaagagatgttttattatttctgagatttctagcttttaaaagtcacaagtgagaattcgatagatccaaagagtcctttaatatgttcatcttgtggccttttactttgattatttaaaaacttctgatgagaccaactggcagagctagaaaatccaaaagaatactttgctctgagctttagctgggattttcttctctcacattattttggctttttcaggatttcagtttgaagtttaagtagagtcattcttttgaaatcctttattttattttcatgtttgttcaaatatgagtaccttatgcttccttatagttgccagtttagcagaatacgactttattatgggggcttacaagaagagccttaattatagtaacaaatcaacattttagtattaccattcaaatgagtgtatgcacatctgtttagtactttgagctctgtcttcctctcaggccttgtatgggactttcattaatgtctgagcacatggaacaaagagtgtctacgtccctttgtgttgtaagttaccagaaagttaggcagcctgcttcccatagacgtgttgttgtctccctaaagaaagcaattgtcattatcgttaagttttagaaaa

SEQ ID NO: 12205 - DNA, 874 bp, Homo sapiens
  ENST00000503301
cttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaaga

SEQ ID NO: 12206 - DNA, 575 bp, Homo sapiens
  ENST00000507214
cagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgtttcagacccaaagtttacgcctatcagacctacacagaaaatcgcatctttggagaggaatagtcagcatcaccttgattgaagggagagacctcaaggccatggattccaacgggtt

SEQ ID NO: 12207 - DNA, 1702 bp, Homo sapiens
  ENST00000514780
aaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggtaattcttagcttgtgatctttcagcttttcttgttgagcagaactatcatctgctttcccagatctctctcatctcttcaaagtatgctaccagatttcatactattcaattgttacttttccccataaatttaagccaaccatgtgatgttttttaaatagaaatcacaccgatcaatagcttcaaatcatcctttcactattctctggtcacttctcaacatcattctcagcatctggtctcaactatatatgcaacagggtctagaaaattgctctgagccaggaataaaatgatgaggctaggggagggacaactccagacagaagaaagattcgcacaatttattttattttggggggtcacagaaaattgagtatgaggctttctaaactcagaaattcctgtatcattacatctttatagtatacaataagaacaatttttccccattgtctcttctcactttaagaaataaagtgagaggagtttatggttcctgtaacttactaagccctggctcttcttcaacttgtaagatatgcaaaatataaactaagtgtttaatttgttcagtgatgctgccactgttggacacagatcgatatcaagatgaaacaatttttatatgaatataccttgaaataaatcaaaacgattttacttgtaaaaatcttgtctgctcaaatttctacttagagtcagtattcctttttaataatgactaatttttttagaccctggaacatgacagtctttttccttccattctgattgaatcatgcttttacctaagcttttctttaattttgtcatttttattactgtgaattaatatatatcaaaatgtttttatatttatggtaatgacttaatctgtttgaacaagtgtctcttactgtacattttctccctaattcctatggcattaatggcattaatgaccaaagaataatttggcttacaaaaaagtcagggctcccattaaaaatcacctttattattttaataaaatgaaaaaggcttattaaggaaggttgctgaatatttctaacttaatgttcactgtgattttcactaatcaaaataaagtttcaagatgttttgaagaaatatttgcactgttcatatttgtattactttttcctttacagttatactttacagttattgttatattaaaagtgtatatatttttaaattcata

SEQ ID NO: 12208 - DNA, 369 bp, Homo sapiens
  ENST00000512568
tctatggccatgtctgaaatgggtgtgaaggagcttgctctccttggggattgtacatctttcatatcctgcttcctactaggtttgttagagaaaatacagttgtgctacatggccaggaagaagaggaaacacacatcagtgagggggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaac

SEQ ID NO: 12209 - DNA, 570 bp, Homo sapiens
  ENST00000510732
cattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaccctgtatggtaagattggaaaggacagactaaatgcagtaaacaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggct

SEQ ID NO: 12210 - DNA, 381 bp, Homo sapiens
  ENST00000513695
agttttcacctatacaacactggagctcactgttggtcgtatgggagcaagaggccttctgtgaataagaaacagctaagccccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgact

SEQ ID NO: 12211 - DNA, 483 bp, Homo sapiens
  ENST00000505465
cctgttgtggcttttgccatgaggaagaggttgactactaacactgcatgtttgatttagcaggtgaagtttttagtatttaattcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacaca

SEQ ID NO: 12212 - DNA, 394 bp, Homo sapiens
  ENST00000513857
ggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagttatacctggaaggaataacttgctattcgcacaactgagtgtatgagatcctactccatccacagctgtgcacctgtgaccatgagattgttcgaatgtttgaaaggataaaatacacaaaataataaacactgctggaaccagtaatgcagaagtccccttggctgatcccggaatgtaccagctggacattacattaagaaggggtcaaagtttagctgctcgagatcgaggag

SEQ ID NO: 12213 - DNA, 703 bp, Homo sapiens
  ENST00000432027
agacggtgaggattgccttcggaggtgggtgaggcccagcgtgcgcgcccaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacc

SEQ ID NO: 12214 - DNA, 1183 bp, Homo sapiens
  ENST00000419164
tccagagctcccggacagcagccggatcccggccggctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggact

SEQ ID NO: 12215 - DNA, 1622 bp, Homo sapiens
  ENST00000373051
ctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccgtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtcca

SEQ ID NO: 12216 - DNA, 353 bp, Homo sapiens
  ENST00000441667
ggagcgaggggggctggagggagagaaggaagaaggaaggggcgaacggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcacccca

SEQ ID NO: 12217 - DNA, 1629 bp, Homo sapiens
  ENST00000230321
ggggctggagggagagaaggaagaaggaaggggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctcaga

SEQ ID NO: 12218 - DNA, 809 bp, Homo sapiens
  ENST00000373050
gggcgaacggcgtgagctggcgccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtccggggccgatgtaccaggtgagcggccagcgcccctctggctgcgacgcgccctatggagcccccagcgcagccccgggcccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtgg

SEQ ID NO: 12219 - DNA, 635 bp, Homo sapiens
  ENST00000446650
ccgaaatgggagaaagcagcgagtgagaggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccgg

SEQ ID NO: 12220 - DNA, 650 bp, Homo sapiens
  ENST00000435476
ggggaaggggcgccaggcgagcacccgggagccagcgggacctgggcaggggcgcccggagcaggcgcgcatggcgggccccgcgcggggatccggctggaagagagcgtagcacggctcgcacgagtgagtggacgtgggaggcgcgcatctgcgggggaatcgccccttgcccgcctccggcgccgcccgctgagccctgttttccgcaggtccggggccgatgtaccaggtgagcggccagcgcccctctggctgcgacgcgccctatggagcccccagcgcagccccgggcccaggccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgct

SEQ ID NO: 12221 - DNA, 549 bp, Homo sapiens
  ENST00000471092
atcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaaggtaagcacccatcccatctctccctgggagaggcctccaaagccgggttcctcgaagcatgacgcatgggcccactggagcaccttcaccaggctgttacttagagatgcaggatctcagcctccttccacgcctactggattggaatctctggtggagcttaacaagccctgcagggaacctgacgcatgaccaaatcttagaaccttgcaaagtacacccgttgggtaaaggtgtacctgccttctcaaggccacctccccacccca

SEQ ID NO: 12222 - DNA, 10736 bp, Homo sapiens
  ENST00000434837
ggagagcgagagaccgaacgaggagacgcgaggaggagggaggaggaagagagggagggaggcgggaggagcgcggaatgaaaagctcggaggggcgaaaaagcagcacagcaaagcccaagttgctgagcgagcggagcgctcccgcggcccggagccgagcggccgccgcgccccggagcccggcccggccccgcccgctctgggcccccgcaggccaaggccgccgggcgggggcggggacgaccaacttggggcgcggcgtagccccgctctcccgagagctcggagcccgggagggctacggccgcggccagacggcgggagaggagcgcggcgagcggaggcggcgagcggcgcccgcgccgcagccccggcctgggcgagagcgcgaatatttttcaaaagactcaaactttcctcctttccccgttttctggggcccttcttgcctggaattgctctccagattcccgcggggcgccgggctgctattcttcccccgggtttatcggcggctcggctaacttcacggacccggggacccgcggcgctcgtccctcggccgaacccagcccgcgctgctccccggatcaggagggccgggcccggggctgcttcgccgccgcgagtgctttcagcccggccccctggagtcgggccgctgagcccacggcagcggccgcaggactggaaacagcagattgattaactcgagcggagccccggcctccccgactccgctccgctgaggggcggccccagtgcggggaaacgacaagtttgtcagtcgtccgtggcctgttggatcgaagcgccgcctccgccgccgagaggtccccggcgcctagcatcccgcgcggacggccctgggtacccggggcggctcggcggccgggctcctcgggtcggggcgctggctgctgtgccgggcgcgccgaggcacccggggctgggccagcgccccctgcgtccccacgcgggcagcggccccgccggaggagaaacacgggtcgccgccacctccgcctcttcagtctcctggtcttcgtcgccgctctctctctcacctctcagggaaagggggggacataggggcgtcgcggggccccggcgaatgcgccccccgccgcctctcgggctgcgccgcctcgcggggatgaagcaccggccgtgaagatggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgacctgccagcaccttctttactgcaaagacaggggacttgcctgaatggcatccgccaacccagggacctcggcgcaacataggccttgtccttgctgcactcgtggtgtgcttctgactttaccctgtcccctaagtcaaggccgaactccagcctggtggctttgccagaagggagccagaagtggggcagacatggagcccctcccttggtcagactctgggactcctgagatgggagaggcagggatcagaggacgaacaggtgggactttgcgagctctgtgactgtcccacgtccaggagacaaggaaggtagggcacctgctgcacacgattctgtccagagtgagcactggatggtggagaccataggtcaccccagattccttgacctatttctgggacaccatatttccctcctcagtgtgcaccctttgaagggacccagcacagggtcttgggcctgggcagtctgaagactgataacttccccactccaccctacaagcagtgggactcctgagaacacggttctctcctagcctcagcccccagctgggtctcagaggagctgggggagcggtggccagcccattttctggggtgaggcttgacttggagaaaggcagaagagacgtcccgcttctgtgatttggtgcccccatatcagacaatgaatttggaagtggagaggggccttcatttcttatctacttggcatgaaagggtgccctggataggagggtgtgtacagggcaaaatgccaaaaagcactgtctagttgaaagttcccttctccacccaggggcagtgaaggaggaggggcttatagagctgggattggtggagggagcaggtgccagtcccctcactctctgggagctgtgaaagggatccctgtccttgggtcctgggttaggcacctgagattgacatgatgggatctagatctttcctccttgacatcacctgagcccccacctagccatccatgggagagagaaggcccagccccttctagaatgactctttaggcatgcgtgcatatgtgtgtatgtgtttgtgcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacggagagcttacagatgaccctattgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccaccttcgccacctcccgctcgtgcccagcacaagtgagcctggtgtggaaaccactccattgcccggtggaatggattctgtaatcagtggttcctggccttgcctgcagaatagaaccaccagagtcctttaaaaagtattgctgcttggttcccacctcagaggttctgagttaattggactggagcgcagtcggacatcaagaaatgttgaaaagctccttgggttctcctgacagcaggaaccactggcctggcaccacctgggtgcttcctctgtgccctcgctggggtaggcattggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaaatgtgtctgctgaaatgctgaggtccccacgtgtgaatgggtgaggctgatgtggatgtctgtgtgtgccagcaggtgggtgggggatgtgggtgtcagtgtatgccagtgggcactgtaaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttgggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgcgtgtgtgtctgagaatgtgtgtgatgtgtggagtgtgcgtgtgtttgtgtgtgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttgccctcttgttgcctgcactcatttcccagggaccctcctaggataggactgccctccttcctggccccctcccgccatcctcccagccacccacataatcaccatctcagcccaactctggtggccctctaggtctccatgcattcttcctgccctagagtagccagctcaccaaggcctttatccccagcccaggagaagggtcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagcgctcagcgtcagccgtgtgtgttggcagggcagagtgggccagggtcggggccggggcactggagggctcctctcagctccctgggggcagcctttcttctctttggcacctgtcgacagggatcctgctctgtggcctggacagtgaggacctgcatcctggtctgctcccagtgaacttgtgtgcatttgttcattcagcaaataccaaccaaacactgcctttgtggaagcccctgtttaatgggagagatggacagtaagctaataatgacaccaagacatatataatgatgtgtacagtgagggctgggaagggaaattggtgctatgaaagaaggtatgaagagggttcttatttgggttggggcttcggggaagacttctctaagagacatttaggagagacagaatgattggagttagcctgttgggattgggagaggcttctgagcagagggaacagaatatgcaaaggccaacagggcccaaaaacttagaaggctcaaggaaggggagtaagggcaaaggaggaggactaaagttggtatggtggttgaaatgccattttcccttctcggcacccaaccctaccatccctcctacacgcttggagtcccttccctcttaatctctattctggccctacagaccccaccctgcaccctacttggggctgcctcccttattcaccaccagctagctgcatccttgccctaagatcaagttatgccaacctttccctttaccccagacctctcagaattctagaatttcagagctaggaggtccttaaaggtcacttatttcaaacatctactcatatattgtaggtgagatgggcttgccaaggtcatggggataggcagtgatgagcatttgcaaagtgaccccaaatcaagggtgtggatgtcatgatatggactacatcatatcaggcaaatgacaggaagtgtctttcaggttacttggttacaatgattcaggtaggtcgattgggcagtttcacttccatgttccagatggggaaactgaagctcagattacaagaccaagggctccctctccctaccacctaagttttattggctctcatgttgggtaacttcttgctggcacacctggcctttcttttctaatggaagaggaagggtctaagggactcaccactgctgtaggttggctccctgagcacaggaagagaaatccgctcaagctcactcaagtacaggtgcattattgtgaggacaaacacagtgagggggatgggcactcagaaatccaaacaggagttgcaacagggatggttttcctgaaccagatgggcattttggattcaaggtagctctaggatcatcatctacagaagtttctggtgcttctgtattcttctggtgcttctgtattctacctgtggtagaataaagatggctgcaaatcccatgttatccttcctgtagagaggcagagtctaattcccttcctcttgaatctgggttgctcttagtgccttgtttgtgcaatagaatgtgacatgctgagttgaagatgccttggagcttcagctcaggcctcttggaacgttctctctggaagccctgaactgccacctaggatgtcctctgagttgctctgagaccgtcatgctggaggggctctggctgaccatcccagctgagtccagccttccagccatctccaccaaagcaccagaagatatgggagtgcagctgcctcagaccttccagaccagcctaactgccacctgaattgctcggccaagctctgtccaaattcctgacccatcgtcatgggatataataaaatagttgttttaa

SEQ ID NO: 12223 - DNA, 5120 bp, Homo sapiens
  ENST00000373401
aattgagcaccattatatgccaggcactgttctaggacactagaacaagacaaaggcccctgtccttgaagagcttacagtctactggtgccaagccttataaagaaaataatgcagaaaaaagaacagagagctattttacatggggtggtcagggacttccttgagggagggaagaatgttccaggcaggggcaacatcacaagcaaaggccctaaggcaggaactggccctcaagtgttgaaagaaaagcaaggataccagtttgctagacccgagtggcagcaaatgagatcagagaagctgacagcgcccagatcaggtgtggaaggccaggagaaggacagcgatgggaagcctcaaaggagactgagcagagggggtaacatgattggagacaggggtcccctccgcagcagccctgctggatagtcctgtccagggacaggatgctcccccaagacagcccactcttttgctgggcaaatccgatacatccagggtcttccttagatgcagttcaaatctgcctcctgcaagctttcacttgctggtgtttattccaccccatggggaatgcagagcacggacagtcacacagactgtcctctctggccttctggacccaacatactcctcttgccaactgggtattactggaccttactgggccttactggacccaacatactcctcttgccaactgggtattaaacattttaaaagcccttcatctccctccacaagtcatgtactgccaacagggacacactgttttctttggaaaccctgctgcgtgcccagacagaggtcccactgccctgggacagctcccttgcctagaggggaagggtagggtgtgtgtgcatgtgtgtgtttggggttggggagattagctgattagcagggcaggaaagaaatgaaagaaaatttgcaagtcatcctgatgaaatgaaatcctgctgaagtcttctctttcccacactgagggtgtccctgcaggaatgggacattgcacccagctgggcatggggaggaggtcctgtcaacagggacagggctgcaggctatggtgggagaagagggcttggtaaatgtggaaaggtgagggtgccctggccagatctcactgcccactgtcttcacacccaccgcaggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgacctgccagcaccttctttactgcaaagacaggggacttgcctgaatggcatccgccaacccagggacctcggcgcaacataggccttgtccttgctgcactcgtggtgtgcttctgactttaccctgtcccctaagtcaaggccgaactccagcctggtggctttgccagaagggagccagaagtggggcagacatggagcccctcccttggtcagactctgggactcctgagatgggagaggcagggatcagaggacgaacaggtgggactttgcgagctctgtgactgtcccacgtccaggagacaaggaaggtagggcacctgctgcacacgattctgtccagagtgagcactggatggtggagaccataggtcaccccagattccttgacctatttctgggacaccatatttccctcctcagtgtgcaccctttgaagggacccagcacagggtcttgggcctgggcagtctgaagactgataacttccccactccaccctacaagcagtgggactcctgagaacacggttctctcctagcctcagcccccagctgggtctcagaggagctgggggagcggtggccagcccattttctggggtgaggcttgacttggagaaaggcagaagagacgtcccgcttctgtgatttggtgcccccatatcagacaatgaatttggaagtggagaggggccttcatttcttatctacttggcatgaaagggtgccctggataggagggtgtgtacagggcaaaatgccaaaaagcactgtctagttgaaagttcccttctccacccaggggcagtgaaggaggaggggcttatagagctgggattggtggagggagcaggtgccagtcccctcactctctgggagctgtgaaagggatccctgtccttgggtcctgggttaggcacctgagattgacatgatgggatctagatctttcctccttgacatcacctgagcccccacctagccatccatgggagagagaaggcccagccccttctagaatgactctttaggcatgcgtgcatatgtgtgtatgtgtttgtgcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacggagagcttacagatgaccctattgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccaccttcgccacctcccgctcgtgcccagcacaagtgagcctggtgtggaaaccactccattgcccggtggaatggattctgtaatcagtggttcctggccttgcctgcagaatagaaccaccagagtcctttaaaaagtattgctgcttggttcccacctcagaggttctgagttaattggactggagcgcagtcggacatcaagaaatgttgaaaagctccttgggttctcctgacagcaggaaccactggcctggcaccacctgggtgcttcctctgtgccctcgctggggtaggcattggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaaatgtgtctgctgaaatgctgaggtccccacgtgtgaatgggtgaggctgatgtggatgtctgtgtgtgccagcaggtgggtgggggatgtgggtgtcagtgtatgccagtgggcactgtaaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccag

SEQ ID NO: 12224 - DNA, 3021 bp, Homo sapiens
  ENST00000505425
atggaggtgacctgccttctacttctggcgctgatccccttccactgccggggacaaggagtctacgctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagttcccgccggaggtggagcccagttcccaggacgtgcgccaggcgctgggccggcccgtgctcctgcgctgctcgctgctgcgaggcagcccccagcgcatcgcctcggctgtgtggcgtttcaaagggcagctgctgccgccgccgcctgttgttcccgccgccgccgaggcgccggatcacgcggagctgcgcctcgacgccgtaactcgcgacagcagcggcagctacgagtgcagcgtctccaacgatgtgggctcggctgcctgcctcttccaggtctccgccaaagcctacagcccggagttttacttcgacacccccaaccccacccgcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcccatcaactctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaaggtgcaagacgggaaggaggtgggggagctgaatctggagggagctgtgcgtggcgggggttcctgtctgttgagggagggtgtttgggtctgaataggggttcagaatgtctgagtgatgggaatcatgtggctctgactgtgtgaaggtgtgccccacactcactcaggctgtgtacttgtgtaaacaatgagaagcctggcccccaccctcgtgatgagcatactgacctgttcacggtatca

SEQ ID NO: 12225 - DNA, 201 bp, Homo sapiens
  ENST00000503419
aagattctgcatccactggggctcccaaaccatttgcacagatcattttgcccgtggctgggtctggacttcataagaagcttcttctggggtaggtgagagtggatgaccaggactccaccaccctgccgagtcctctcatttccatttggcttccccaggctccctcaacctcctggtgcggtcccggaacaaaggggc

SEQ ID NO: 12226 - DNA, 478 bp, Homo sapiens
  ENST00000418178
tgaaccagcacaatgcggtggtcaaggccatcccggtccggcgtgtggagaaggggcagctgctggagtacatcctgaccgatctccgtgtgccccacagctatgaggtccgcctcacaccctataccaccttcggggctggtgacatggcctcccgcatcatccactacacagagcacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacct

SEQ ID NO: 12227 - DNA, 582 bp, Homo sapiens
  ENST00000502298
ccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtacatcctgaccgatctccgtgtgccccacagctatgagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggtggtgaaggttgcagtgagctgagattgtaccattgcactccatcctgggcagcaagagcaaaactccatttcaaaaaaaaaaaa

SEQ ID NO: 12228 - DNA, 655 bp, Homo sapiens
  ENST00000510077
gacaaccgcgccgctttcaaacatagccttcccacaggcctaggcttcgcctctctaccagcacccaaaccaggcctagaccccttcgaaacccatccaagccacgtctgggctccgcctgcgtaaggcgtaggctccacccctttcagctcggtccaatcccagcttccagccgttccagcagcaggcagcatcccttccagccccgcttccaccagcgttagagcccctcaagcccaggccacagccccatctcagcccctccccgctcgtccttgacccctgaggctacagatggggaacccttcgggagcctgaggtgtagtttaggggagagaagacgcccctcagcagcttctctggaacgttgttgcggggcactgggccagacagcacacgtttcgtgagctggcaccctagaggtgcaggcccttcggtgcccagaaacccctctcagccccagctcttcgaggcattctcagccacaagctgtccaagaactactcctacgtgctgcagtggactcagagggagcccgacgctgtcgaccctgtgctcaactacagactcagcatccgccagttgaaccagcacaatgcggtggtcaaggccatcccggtccggcgtgtggagaaggggcagctgctggagtaca

SEQ ID NO: 12229 - DNA, 2430 bp, Homo sapiens
  ENST00000478143
taacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcaggtcaggatgggcagctggctcgccccataccacttctcctgcatccaacaggggaggggggcatggggctgagtttttgggactgccttgacttcaacaattctattcttactttggaaacacacattctgattggagttcagacagcctggggcagaaaaatcagatggaaaggtcagggagcagcaatgagggcaggagtgtccccgaggcaacatgtcctccaggaacattgctagttaggaaaaggcacccctaggggcagacaggtcatcccagtctgctgctgggtggcagagtattgggaacctgtggccaggcacagcaggatctgggggcgaggagatgactcctcttcccatgggccctgatagtcccaggagatggtggtgatgccattctgccaaggagggctttcagcggtggctgcaggccagccccatgtttgtgtgggttgtacgagtaagttcccttcttacccctccgtttcccagactggagaaaccaaggcctggtacttgccagtgtgcacaagggcaacctcagacccagagaatcccatgatgaggcactgccaaggctatggagagtgtagcatccaccccaggctcaggacccctggggctaaatggtgagggtggggttggggatggaaagagaggaattagacaggcatttgtggtaggctctggtgctgggtgaatgagtatgcgggatccctggagactcaagcaggcacctcaccccagtggtccactgctgcccagggggagaccaaggtcctgaagctgaagaacctgcggccccaggactatgccagctacacctgccaggtgtctgtgcgtaacgtgtgcggcatcccagacaaggccatcaccttccggctcaccaacaccacggcaccaccagccctgaagctgtctgtgaacgaaactctggtggtgaaccctggggagaatgtgacggtgcagtgtctgctgacaggcggtgatcccctcccccagctgcagtggtcccatgggcctggcccactgcccctgggtgctctggcccagggtggcaccctcagcatcccttcagtgcaggcccgggactctggctactacaactgcacagccaccaacaatgtgggcaaccctgccaagaagactgtcaacctgctggtgcgatccatgaagaacgctacattccagatcactcctgacgtgatcaaagagagtgagaacatccagctgggccaggacctgaagctatcgtgccacgtggatgcagtgccccaggagaaggtgacctaccagtggttcaagaatggcaagccggcacgcatgtccaagcggctgctggtgacccgcaatgatcctgagctgcccgcagtcaccagcagcctagagctcattgacctgcacttcagtgactatggcacctacctgtgcatggcttctttcccaggggcacccgtgcccgacctcagcgtcgaggtcaacatctcctctgagacagtgccgcccaccatcagtgtgcccaagggtagggccgtggtgaccgtgcgcgagggatcgcctgccgagctgcaatgcgaggtgcggggcaagccgcggccgccagtgctctggtcccgcgtggacaaggaggctgcactgctgccctcggggctgcccctggaggagactccggacgggaagctgcggctggagcgagtgagccgagacatgagcgggacctaccgctgccagacggcccgctataatggcttcaacgtgcgcccccgtgaggcccaggtgcagctgaacgtgcagtgtgagtccaccacgccacccggactaccttcccagctttccttctggctcccagccggcctgtcccctcttcatcctctcacccaccccagtccaaccaaaccccaccagctactcctgatacccctaatgctccttgacagccccatgctgtaggacacggaggtctgtgttctttgctccatttcatcaagtatctcccatcttcattttcagggacccggtgaacaaaaaaaaaa

SEQ ID NO: 12230 - DNA, 594 bp, Homo sapiens
  ENST00000515437
agtctccccgcttgttagctgctgcgattgtctgcgctcccacgggccgacctaaaacaattcttgcgcacacgctgagataaataacggcgacaggtggagcagctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgaca

SEQ ID NO: 12231 - DNA, 542 bp, Homo sapiens
  ENST00000508399
actgtccctttcctgagttcctggcccgcctggttctgtcctagaggtcctgggaggattctttcctgggctcagtggggtcaggcctctgaggaatggcctggggagatctgggctgacccctcccagatacactcaggagggagccccagacttcttctggccttggcacctcttctctaaacctcctcctccatcctctcctgccagctccagcccaggcgcagatcgtgcatgcgggccaggcatgtgtggtgaaagaggacaatatcagcgagcgtgtctacaccatccgggagggggacaccctcatgctgcagtgccttgtaacagggcaccctcgaccccaggtacggtggaccaagacggcaggtagcgcctcggacaagttccaggagacatcggtgttcaacgagacgctgcgcatcgagcgtattgcacgcacgcagggcggccgctactactgcaaggctgagaacggcgtgggggtgccggccatcaagtccatccgcgtggacgtgcagtacctggatgagccaatg

SEQ ID NO: 12232 - DNA, 5075 bp, Homo sapiens
  ENST00000399232
acttcgcctcgcagctccccttcccatcaccgccccctgctcctccccggcgtctgcgattttcccaggcacccggtgtgagtgcggcgtgcgtgtgagtgtgtgtcagggtattgtgttgtgggagagtgtgtgagtgtgtgtgagtgtgtgtgtgcatgagtgtgtggagtgcggggctcctgcgctccgctcgccgccgccgccggggaaggacagacggacggcgcttcctccttcggcgagcggttcccgggcacctcggcttggcccgggcgcgagtggagcgcgcctggctggccgccggcctcctgaaggtcccgttgcgtaccccctgggctggatatgttcatgttcacgtgaagatggatttactgtacggtctcgtgtggctgctgacagtcctcctggaggggatctctggccaaggagtgtacgctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttccttaaattatctcagcttttaacttcatttaaaaagacttttgtctaagaagaatattattattatatgttctttcaacaccccaggattaaaaaaactgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggta

SEQ ID NO: 12233 - DNA, 2965 bp, Homo sapiens
  ENST00000357362
tcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaattttttt

SEQ ID NO: 12234 - DNA, 3635 bp, Homo sapiens
  ENST00000557238
ggctccagccttggccagcccagaaaggggctcccacagtgcagcggcgggctgaagggctcctcaagcgcggccagagtgagtgccaaagccgaggaggcgccgagagcgaaggagggctgtgagggctgccagctggctgtcacctcacagtgtagcggacaggaagaagaatgttgccaggcagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtggagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggctcttgctatgttgcccaggctggtctcaaggaatcttcccaccttcgcctctcaaaatgctgggattacaggcatgagtcattgtgcccagccagaaagcttttgagaagttaaactactataaacttgaagtcaggagacctgggcaggaacttggctgtagcacttcatcactgtaatacttcagagaaatcacttaaaatgtctgaaccttggtttccttatctgtaaaatgagaataataactcttatttcagaaagctgtagtttaagttaaattaggcaacatacatagtatcttcaaccagatggcagacactcataatcttaggttactttgaatctgaaatagcaataataatagcaataataaaataatagttgacatttatggagtactcatcatgggctaggatactttgtggattatttctcttaattttcacgatcaacatttgtgcttattaaaatcattatcctgtttcatagataacaaaattgaaatacaaaggactttagttaccatgcccatcacctggctaagtagtgaagccataacacaaacatgggaagctggacagagtctgcctgttttattactgtgcaggaacacttgttggaagattttgcaagcctagctaagtatgtgacagttacttagtagtggtgtgagttattagattttctgcaatcaaaaagcataatgagatatttgatttaggaaaataaacataaaaataggtaaaatcattcagaaacagaatctagactgggaatcacttaaagaaccaatgaaaggaaacaaatcgcataattgccaagccattttatttattgtgggattactatattattactaatgtaggattagctcaactctaattcttcctttttgttaataatgtatactctgtttcctctttgttttgaatatgtgtcatgtactttctttctcctcttccaatttacattggatcacatattttaattgatttttaaataaatatttccaagaccaata

SEQ ID NO: 12235 - DNA, 593 bp, Homo sapiens
  ENST00000557516
ggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtggagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgagatagcaataattactgattcttacaaaattaatgataactaagaagaaaaaggttcataaacacacagcattaaaacaatttttggtcaaagaa

SEQ ID NO: 12236 - DNA, 644 bp, Homo sapiens
  ENST00000555521
ctttctgttttcaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtatgggggtatgaccttttgtgttcatagcaatcagagacttttaaaaactgctataaatatgaaatactaatatttagccatatatttgaagattatggaataaaatattaaattttctgtaca

SEQ ID NO: 12237 - DNA, 757 bp, Homo sapiens
  ENST00000554762
aaagatcttaaaactaaagaatcttcgacctcaggactatgctaattatagctgcattgcttcagtgaggaatgtatgtaatattcctgataagatggtgtcgtttagactgtccaataaaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtct

SEQ ID NO: 12238 - DNA, 1918 bp, Homo sapiens
  ENST00000482848
gcttgagcctgtaccagaatgataagtggaaattagtcctcaaagtaacctcagctgtttcattattgtgtgcctcgagcatctggttattcaagctcctcccacggttcgtattgtgcactcaggcttggcctgtaacattgaagaggagcgctactccgaaagggtctacactatccgggaaggagaaacccttgagttgacttgtctagtcacaggacatccacgtccacaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacaggtaacactattggagataaaagaaatatattgacttcttccaaaacactacccctggaaagtacccacttaactacagatagatgtggtttctccatagaatggaagctctacaaagtctgagactttgtctgcatcactcattgctataatctcaatagccgaaacaatacatggcacatagaagacaggagcagctcctcaatttgtggtgtccagtgaaaataaaaatgcatgccccttgttcaaaaattaataaactcactatggcaacatcaaagcattaaagcaaatttggggctgttctaagtgtggctacacggatggcaggctcttgaggctagatggcctaggagattttattgtgatagaaggcctacagaagatgatgcctaacctaaagaatgagttactgaagatgattacatattctgtcttcaagccaaaactgacctttgatgttccaatttgcttacaatagagtggaatactagaatgcagtataaagttctataaatctgagattgtatgattcaactgacatcattaaaatgatatttatcccaatactattgaagactaaa

SEQ ID NO: 12239 - DNA, 574 bp, Homo sapiens
  ENST00000486952
aaaaaaacaaacaaacaaaaaaaatcaccattccttttaatagcttgagcctgtaccagaatgataagtggaaattagtcctcaaagtaacctcagctgtttcattattgtgtgcctcgagcatctggttattcaaggtgaggcttccatgttcaagtatgaatcccttgggatctgccgcaggactcacggtagtgctgcctgcttctcccactctgtggctgactcccctgaggtagcattctgccaggcaaagctgcctttccttcctcctactactgtgacttcagaagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtct

SEQ ID NO: 12240 - DNA, 511 bp, Homo sapiens
  ENST00000472499
gagcatctggttattcaaggcctctccagtgtctctcctatgtctgagacatagtggcaagctgataaggctgtacagtggcaagggcaaaggagatcttaacccttagtccaatttaaggatgatgaattgaggttttttaccaacaaggcagaggatcagagatgtcttgcttcagctcctcccacggttcgtattgtgcactcaggcttggcctgtaacattgaagaggagcgctactccgaaagggtctacactatccgggaaggagaaacccttgagttgacttgtctagtcacaggacatccacgtccacagacatggaatagaaatttcagaatcaaaagttgggatctaaacaggagggtctaaacacatccaaaagaagccttgaagagctttatgagaggcagtttatggcaagagaagactcattgaggttcccattagtcccacaaagagtgtactaaatttacaccttctgaactccaaattatattttaaaatgcaa

SEQ ID NO: 12241 - DNA, 2871 bp, Homo sapiens
  ENST00000426342
atggatttactgtacggtctcgtgtggctgctgacagtcctcctggaggggatctctggccaaggagtgtacgctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtga

SEQ ID NO: 12242 - DNA, 494 bp, Homo sapiens
  ENST00000469768
aactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggctgcggcggccggagtgaccccgccgccgccagccccagcccgctagccgcggaccaacaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttc

SEQ ID NO: 12243 - DNA, 2757 bp, Homo sapiens
  ENST00000422248
gtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 12244 - DNA, 2862 bp, Homo sapiens
  ENST00000309237
gtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggaggaacagagtattatggcgcatatgggcattgactcaggaaccactaacatttttgatgaagtagacaagagtgactttaaaactgactttggttcggaatttccaattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtaagtcattgcttcagttaatctataccctgattattttattataagatcaataactgttgaacgtcagattattcaa

SEQ ID NO: 12245 - DNA, 10744 bp, Homo sapiens
  ENST00000474524
ccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcagtattcagatgagtttgttcagtcggcctacctgtctcgtcgtcttgcctacttttgtgcccggcgtctttccttgctgctgagcgatagccccaacctccttgctgcccactcaccccacatgatgataggaccaaacaactcgagtatcggggcccccagccctggcccccccggccctggcatgagccccgtgcagctggccttctcagattttctttcctgtgcacagcatggtcccctggtttatggacttagttgtatgttgcagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgcatcgtggctgttctcaggcgctatcacagttgtctaatcttgaatcctgatcagacagcccaggtgtttgaagggttgtgtggtgtggtcaagcatgtcgtaaacccctcagaatgttcttcccctgaaagatgcattttagcctacctctatgatctctatgtgtcatgtagccacctcagaagtaaatttggagacctcttcagtagtgcctgttcaaaagtaaagcaaaccatatataataacgtgatgcctgcaaattcgaacttgcgatgggatccagacttcatgatggattttattgagaatccctcagcccgcagcatcaactactcaatgctgggcaagatcctcagtgacaatgcggccaatcgctacagctttgtctgcaatacactcatgaatgtatgtatgggccatcaggatgctggcaggattaacgacatagccaatttctcctctgagcttacggcttgctgcactgttcttagttcagaatggctgggggttctgaaggctctttgttgttcttcaaatcacgtgtgggggtttaatgatgtactttgcactgtagatgtgagtgacctttcattccatgattcattagctactttcattgctattctgatagcacgacagtgtttttccctggaggacgtcgtgcagcatgtcgcacttccctctcttctagcagcagcttgtggggatgcggacgccgagcctggggcgagaatgacatgccgactcttgcttcatctcttccgagctccccaggcctgcttcttacctcaagcaacgggcaaacctttccctggaataagatcatcttgtgatagacacctcttagccgctgctcacaacagcattgaagtgggagccgtgtttgctgtcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagggccagccgggggaccaggctgctctctttgctgcgcaagcacggccctcccctcagctccctcagtatccagggctgcagcaagcacagaccatgccacagggctatacaatgtatgggacacagatgcctttgcagcagacatcgcagcagcaggctggcagtgtggtcctgtctcccagctataactccagagcctatccggccgcacattccaaccccgtgctaatggaaagactcagacagattcagcagcagccgagtggctatgttcagcagcaggcctcgccgtacctgcagcccctgactggctctcagagactgaaccatcaggctctacagcagagccctctggtgggcgggggaattgatgctgtgctgacttctgcacatccaaaccttccctccgtgcccctgcctcaggatcccatgagacccagacagccgcaagttcgacagcagcagagactcctccagatgcagcagccccagcagccccagccccagcagcctccccagccccagcagtcctcgcagtcccagagtcagacccttggtctccaagcaatgcagccccagcagcccttgtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgtttttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggccccaaagtccagaaggctctggttttcataaaaggtgtatttgctgtttattttgtatggtaagtatttgctcttttgaatttaattattactgtcagtgtcagtcttggttgtgtattgcatatactgtatttataaattggtgcaaaaagcacaagtaaattatacatcaaatttattataaagaaatagtaactattttaactttgttcaagtatgtggtaatttgctcctattagagtaaaaaagaaaccagtaaattatcagtttgtgtaacttaagagtattctatataatatttttttagatttagatgcataaaattttgaatgtgaaaattgcagggcattttaaaacatatgtgggggatattttcccatgttctctgttatttcattttcttttgccatatgattttacatataatatagtcaagcatactgtgaatagacttgtctataatgagcagaccatgtaaatctactttttttaaaatgtagctagtacaactttagtagacattttcttttgcaaatcattatctataaataatttatatcttcctgggtgagttactcattgcaaagtttgactcatgcaaatgacctcaaatacatgtcagcttactttgctgtggcaacatccatgtgaactgctttgtacactgtgaaaatatttcactccagcctgcccattttgtgtttactctgggctggaaaagactttgccaaaacattaaaaactattcttttcactaaattaatagtctatctgctttcagaagatgtatcatctatctgtacacatttttgctggttttgtatatcagattttttcctctcaagaaacatacttagataagctaatgaagttgttttcttcaaagtaatatatctatataatgactgcattggcaaatcaaccgaaatgtgaatgttgtgcctagtgagtgagtcatgttccatcattatttctttccaaatttctttgccagttcagtttgaaccatatattttgtagctcagcattgcaaacaacagtaatactgttttaagaatgagtgttataattgcatagcatttgtatgcactttatactttgcagaggtgagttaaattattaatcattttgcacatgaaagctgtggggcatatcttttttctttttttaggtgaggaagttatgctacgactctaattaattccacgattctattgaaagttgaggaatgctgttttacccctgcgcattataaagaaaataactagaattactttagtcttcagattttctccctgttaattctgtatcttgagaggtttcttttttttttttttttttttcttttcttgcaaatgcattcttttgcattaagatggtcacaaggtaaagccctgtggcagaacctggtactttaccttaccagaggaaattaccttagaataagatggagcgagaccccagctccccttaaagacaagaccttgaaatcaaatggagtcagctatacctatcaatcaatcacagttcttggatataagaagcccatagactctcttgtttacactgtaggctttttcttaatagggttgcatttgtcagtcattgcatttacccttcttggcctggaagtagaggagatcaatgcgtagctttgaccacttccagccacagggtactaacatcagacataagttgcaaccaggtcacattttaggctgagatggggctaactgaaagtcagtgtgatgaaaacccaagggcgctattccacatgtctcaaatgattggcaggggctaacttattagtaattctcggttttgtgcactgagatatctaagacctatggcatttttttcccatttataaagctcctataattcttaagtaagtactaggtgaatgtttgaatagatgctggagaaattacactggaaaaccccacccctagatttagataagatcaatcatttaatattccccaaattaattcaggttgaattaagcatgtaatataaattcagtgaattacaaaaacacattttgtgtaggattgatcagattttaaatacagtgaaacttcattatatataatagacctagaccctcccaagcattttcccatcccataaagaattaatgaaatgaaatgcttatagagcaacgattcctgctcagaaaaatttccttataaacagctccaaaccaggggtgcctgagctagattttaaagttataaagaagtttcattgtatttttaaaacctttttaatgggtgtatttggacaaaaataacccccttttcacattttatgatgtgcaggtattacattgctttttacatgtggaaaagtgagcctgcatttatttttaaatgcagttattaaaacatttttgtattccccatcaatgaaaattttcagtgtgaacaaatggtgaatcataagacagttcagtgcttattttctgtaggttttagcaaaaaaatttataaaccacaaaatatttatacatcaggatggtaaatttacatcataaagattgcagatttaatattttccattgtctctgttctgagtgccatgcttgtaacattgataggaggtggacactaggcaactggtattagaagttcatttttttactgaaaaattcaggtacattagccatttgttattttatagtgaaccgtttcaatgtttgtttattgttatttgttggcaaaataaaagtgccttaagttaaaagtttgttttgagatccattaaataaatcagtatcatcagttcataatgcatttatttacaagtccttttattttgcatgttcattgtaaatttaatactgtaaatgtattcaaattcatttacatgcctatggctgcctttgattaaacttcttccaaaaaataaattctgcccagatgttgttgactttattatttcatgtcagattacttgaatatacgttgctgcataatcactaccaagtgggttctttgctgtgcatttgtatatcccagaatcggaggtttggggattctgaatgactagggtaccttgtaagtgaagctgctcacttccatgtgtcctctctttacttgccgttgagagaagggagtggtcaggcatctcccatgtgatttctggcttgggaactcccaaggccacacagtggagctgaaaggctgcccctgtcctggtgacaatactcctgggtggacgatttgtaattcggggagggtaggctacaatcattactggaacagtaatcagtgtatgaccaacactattttgagccttacagatatagtttcctctgtcataagctgt

SEQ ID NO: 12246 - DNA, 6401 bp, Homo sapiens
  ENST00000273432
tctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttattttagcagcatattagctgagaaactgaagcttaacactttccaggacacgggaaagaagaaaccacaagttaatgctaaagataattattggctggttactgctcgatcccagagtgcaattcatagttggttttctgacttagcaggaaataagccactttctattttggcaaaaaaggttcctatccttagtaaaaaagaggatgtttttgcatatttagctaaatattctgtgccaatggttcgagcaacgtggctgatcaagatgacttgtgcctattattctgctatatctgaagctaaaattaagaaacgtcaggctcctgatccgaatttggagtggacacagatatctaccagatatcttcgagagcagttggccaagatttctgacttttaccacatggcctccagcacgggcgatggccctgtccctgtgccaccagaggtggagcaagccatgaagcaatgggaatacaacgaaaagctagcatttcacatgttccaggaaggaatgttagaaaaacacgaatatttgacatggatcctggatgttttagaaaagatcagaccaatggatgatgatcttcttaaactcttgctaccactaatgctgcaggttcgggcaaggatttatgaagtagaacaacagataaaacaaagaggccgtgcagtggaagttcggtggtcatttgacaagtgccaagaatccacagcaggggtgactattagtcgggttttgcacacgttggaagttttggatcgtcactgttttgaccgaactgattccagcaattccatggagacactttatcataagattttctgggcaaaccaaaacaaagataaccaagaggttgcgcccaacgatgaagctgtggtgacgctgttatgtgaatgggccgtgagctgcaaacggtctggcaagcacagggccatggctgtggcaaaactcctggagaagaggcaagcagaaattgaggcagagagatgtggtgaatcagaagtcttagatgagaaggagtctatttcttcatcctctcttgctggatccagtttgcctgttttccagaatgtgctgttaaggtttttagatacacaggccccctctttgtcggacccaaacagtgaatgtgaaaaggtggaatttgtgaacctggtgctgctcttctgcgagttcatccgccatgatgtcttctcccatgacgcatacatgtgtaccctcatatctcgaggagatttgtcagtcactgcctcaactcggccgcggtcaccagtaggggaaaatgcagatgaacactattcaaaggaccatgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgcatcgtggctgttctcaggcgctatcacagttgtctaatcttgaatcctgatcagacagcccaggtgtttgaagggttgtgtggtgtggtcaagcatgtcgtaaacccctcagaatgttcttcccctgaaagatgcattttagcctacctctatgatctctatgtgtcatgtagccacctcagaagtaaatttggagacctcttcagtagtgcctgttcaaaagtaaagcaaaccatatataataacgtgatgcctgcaaattcgaacttgcgatgggatccagacttcatgatggattttattgagaatccctcagcccgcagcatcaactactcaatgctgggcaagatcctcagtgacaatgcggccaatcgctacagctttgtctgcaatacactcatgaatgtatgtatgggccatcaggatgctggcaggattaacgacatagccaatttctcctctgagcttacggcttgctgcactgttcttagttcagaatggctgggggttctgaaggctctttgttgttcttcaaatcacgtgtgggggtttaatgatgtactttgcactgtagatgtgagtgacctttcattccatgattcattagctactttcattgctattctgatagcacgacagtgtttttccctggaggacgtcgtgcagcatgtcgcacttccctctcttctagcagcagcttgtggggatgcggacgccgagcctggggcgagaatgacatgccgactcttgcttcatctcttccgagctccccaggcctgcttcttacctcaagcaacgggcaaacctttccctggaataagatcatcttgtgatagacacctcttagccgctgctcacaacagcattgaagtgggagccgtgtttgctgtcttaaaagcaattatgatgcttggagatgccaaaattggcaataacagtgtcagctctttaaagaatgatgacttcaccatgagaggtttgcgatgtgatgggaatgctgatgatatctggactgcctcacaaaatccaaaatcctgtgggaaaagcatttccatagaaactgccaatttaagagaatacgctagatatgtactgaggactatctgtcaacaggaatgggtaggagagcattgcttaaaagaacctgaaagattatgtacagacaaagaacttatattggaccctgtgctttcaaatatgcaagcacagaaattactgcagcttatctgttatcctcatggcattaaagaatgtaccgagggggacaatctgcaaagacagcacattaagcgtattcttcagaatcttgagcagtggacactgaggcaatcctggttagaactccagctaatgatcaaacagtgcttgaaggaccctggctctggttctgtggccgaaatgaacaacttactggacaatattgcaaaggcaacaatagaggtattccagcagtctgcagacctaaataattcttctaattctggcatgagcctcttcaacccaaacagtattggaagtgctgatacaagtagcacgagacagaatggaataaagacattcctaagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaagtatgtctcttttgagtcaacaacccttcctctcactggtacttacctgccttaagggacaagatgaacaaagggaaggcctcctaacatctctccagaatcaagttaaccagattttaagtaactggagagaagaacgataccaagatgacataaaagcgcggcagatgatgcacgaagcattgcaactccgcctaaatttggtaggaggaatgtttgacacggtgcagaggagcacccagtggactacagactgggccctgctactccttcagatcattacttcaggaactgttgacatgcacactaacaatgaattattcacaacagttcttgacatgctgggtgttttaatcaatggaacgttagcctctgacctatcaaatgcatcccctgggggatctgaagagaacaagcgtgcatacatgaatttagtaaagaaactgaaaaaagagctaggagacaagcgatcagaaagtattgacaaagttcgacagttactacctttgccgaaacagacatgtgatgtcatcacttgtgaacctatgggttccttgattgacacaaaaggaaacaaaattgctggatttgactctatagataaaaaacagggtctccaggtctctacgaagcagaaggtgtccccgtgggacttgtttgagggtcagaagaacccagctcctttgtcctgggcctggtttgggacagtccgagtggaccgaagagtgatcaagtacgaggagcagcatcacctcctgctgtatcacacacaccccatgcccaagccccgcagttactacctccagccactgcccctgcctcctgaggaggaagaggaagagcccacatctccagtttctcaggaaccagaaaggaagtccgctgagctgtcagatcagggaaaaaccacaacagatgaagaaaagaaaacaaaaggaaggaagcgcaagacgaaatctagctcaagagttgatgaatatccacagagcaacatataccgagtgcctcctaattactcgcctatctcctcccaaatgatgcaccatccacagtccaccttgtggggttacaacctcgtgggccagccccagcagcccggctttttccttcagaaccaatctcttactccaggtggctccagattggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagtttcccaggcaaggcttgcagcagacccagcagcagcagcagacggccgccttggtgcggcagctccagaagcagctttccagcaaccagccacagcaaggagtgactccgtatgggcatccttcacacttctgaatctgcaagaggagaagacatgacgttttatgtttgcactgaaaaacagaaaatcaaatttaatgcattagtcatcttaaaaatgtccctttttttcatttctttgacattttactatattttatgctacatctcacaaaaaaaaaaaaaggtgtttaaacaaaaagccaaggagaagttgtggtttgattttgttgaattcacctttaaagtaggtttacaaatgtgaatcatgcaggcaggcctactcccggaagagtgtgctagcagaccttttgaaattggtgctttttttgaatctcacatttctagaaagaatggattatgatggatctaaggtatttatgtatttcattcattaatgatgacgttgtttttttttttttaattttattttccaaactgtgctggaccaaactactgatttgaaaggcatgtcagatcttgacagaaacatggcctgtttattctgcattcacctgtgatggtgaaacggacatttatttgcatcgctctaatttgaaatgtttgtaatctcataagcactttataaactttgttcttatttatgtaggactcttctttgcttttgttgtggtcaaaaggtgctgaaacagattgttgcttcgtacttaaacttcttaaaccaagaacctaaaccaaggtttctttgagagccgccctaagatgtgcggaaacctgttagaagtagctgtactcaaatttgttttgaggcaagatcattgatgagagtcattgtgaaggtacaacatgtaaatcctaaaggcctgaaagaactgcagtggaatcgtccaactatttattgccagttttggttctcctgaaccttatgccaccttaaggggaaaaaaaaatccagtagctggcttgagattccagtgctcacacttgacatggtttccagagaatctggcccc

SEQ ID NO: 12247 - DNA, 749 bp, Homo sapiens
  ENST00000480026
tgatgtgaaaatggagattttttctcctatgcctggagaatcctgtgagaatgccaacacttcgttgggcagaagaatgtcagttaattgtgagaagttggtgaagagggaaaagccaagggaattaatttttccatctaattatgacctccttcgccacttacagtatgcaacacattttcctatacctctggtattgatgtctgttcctccttctgtttgagagtcacctctgaggatcataaaaaattgagataagtgatgtaaacttccacatgtgttatatgttttgtttatgttaaaatagcgaatatgccttgtgtagaattagactgcatgttataagtctgacctgttttatcatttacatttgaacttattgaaatgagaagtcatcttcagaagagactttgcacaataacatgtaataaaggtgttggcattaattcttaaatggatttgatgtagttgtatatggtatggtgagtcatggtatctaatatctttgaacaaagaatttacaacaaagaatgatttagagtttaatgtaaattttgtattttatacacaccaatacaaacaagtaattacaaacagatcaatcactttcctctcagtagttatgctgtgcaactttgtaatcatatttaattaatttttttcactaaggtaaaatgttcattaacctaattagcagctattttctagaagctaattaataaaggtaagtgtcaatgatggtattattg

SEQ ID NO: 12248 - DNA, 575 bp, Homo sapiens
  ENST00000491549
taggaacagctccggtctacagctcccagcgtgagcgacgcagaagacggtgatttctgcatttccatctgaggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatattttgatcaacatcaagtgacatctcagatttctaacaatgtgctagaacaaatcacaagctttgcgtcaggaacatcctatcatctccctttggctcaccacattcagctcatctttgatctcatggagccagcactgaacatcaacggactaattgacttcgcaatacagttactaaatgaactgagtgttgtggaagctgaactgctcctaaaatcctccagcctggcaggaagttatacaacaggactgtgtgtctgca

SEQ ID NO: 12249 - DNA, 568 bp, Homo sapiens
  ENST00000468305
ttgaagcttcatggctcacagtggtgcctcatatcttactgtcagcattctaatttctagtttttcttcaaacctcagagttaagcagaagtataattacagtttttaatcattgctgtgtcttatcaaccacggcttttaagaaaatgaaaaatttttcgtttacctttcattgtggtggctggctgtccattcacctcatacggtgtcttcaagttgaaacaggtttcttgtctctaattaagaataagctttgaaactaaggtcggcagggaagtggattttctggtaaagcatgaaaacgaaacatctcccctaccagacaaggatgaatcttcaagtcatgaatgtaaccagcgcacaatccttctctatggagtcggcaaagagcgtgatgaagcaaggcatcagctgaagaagattaccaaagatatcctgaaaattctaaataagaagagcaccacagagacaggggttggggacgaaggacaaaaagccaggaagaacaaacaggagacatttccaacactggagactgtgttcactaaactccagctcctttcatatt

SEQ ID NO: 12250 - DNA, 318 bp, Homo sapiens
  ENST00000488092
ttggaccctgcaggctcctttgtcccaaccaacaccaaacaagctctgtcaaacatgctacagcggcgctcaggcgccatgatgcagccgccttctcttcatgcaatcacatcgcagcagcagttgatacagatgaagcttctgcagcagcagcagcaacagcgacttctcaggcaagcccagactcggcctttccaacagatgcagcagccccagcagccccagccccagcagcctccccagccccagcagtcctcgcagtcccagagtcagacccttggtctccaagcaatgcagccccagcagcccttgtttccc

SEQ ID NO: 12251 - DNA, 7561 bp, Homo sapiens
  ENST00000504921
gctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgatgcagtgtccgtggtgcatttttttaaattaatgttttgctgtttaaatttattcaattttattgtgttttttaaaaagcagcttatgccacaagcacaaatgagctttctcagttttcaactcaaaatattatatgaaaagatggatatgtgtgtctgtgtgggaggggtgtgaattggatgacggttcttagggtattacagaattcagccagtggtggaagtctaaggttcttattgaatggttcaacttctttatcaaagaagttccatgaagatctttgataacctgtttaaatgtacagaatttttcaaaagccactgtgaaaagcagtaccataagttattttttaactaaaatctgtagaaagtgtttccaaaagagttccttttttcttcttcgaagtaatttctaaaagttgaaaacataggcttataaatctgaataaattagtgaattcatacattttagagactatcaaatatatccattattaacattcaataataatctctaaaggggaatgtccttaaaaagattgatagaaagattaatttaaaaactgaaaaggaaaacaagacaccaccagttagccagctggagaacttggacttttgcattagtagtgatatctgctccaaaaagaatgcagttcgaggaaatgttgcatgtggcttcaaaatagcagtgctttctgctttgttctcttgtattcattttcagcaaacatgtattaagcaattattatatgtaactcatgtggtgattccaggatgaatgaagttgtagccctttctcttaggaaacttataaactaataggagataaaaggcattctcagggaagtctacaaagtgctatgagggagccactttggccatcctggggcagagcagaccagaggctcagagcatggacacttcctcatccacccagcagaagcctttcacttgattttgaaggtgggcaggattgagaaaggcccagaaggggatgagttcaaagctgtttgtgggcatgtgacccctgcagtcacatatggccctagcttgtgtttcgtttagtgttctgctatcattatcctgataatatcctgataataaaattatccttaataatttta

SEQ ID NO: 12252 - DNA, 6192 bp, Homo sapiens
  ENST00000340208
caaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 12253 - DNA, 6336 bp, Homo sapiens
  ENST00000424173
agcaattctgtgttcttttgccagcactgacaaaggtctggttgtcagtgatacctttacagctaaatttactccagagtgacagaaacaggtgcacctcggcctgccagacacttgtgcagagagatcacgcatctcacggcttgacgatcaagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 12254 - DNA, 6088 bp, Homo sapiens
  ENST00000637481
gcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcag

SEQ ID NO: 12255 - DNA, 5936 bp, Homo sapiens
  ENST00000636998
gaaactgatgatttctccagctcgcgaggaaagagtcaacggtttgggattgtgggggagagagagacggagagaaaaaggcagcgcgaagcaaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcag

SEQ ID NO: 12256 - DNA, 4343 bp, Homo sapiens
  ENST00000625674
aaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaa

SEQ ID NO: 12257 - DNA, 4340 bp, Homo sapiens
  ENST00000437473
gagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaa

SEQ ID NO: 12258 - DNA, 3467 bp, Homo sapiens
  ENST00000625585
ggaaattgtcctatatgcatttgctgtggattcatggattggctttctgtgatagagaaagcttgtttgtatctttggggtcttaaacgtgcatgggaaataccattctaacacactgcttgcttctaagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaa

SEQ ID NO: 12259 - DNA, 3393 bp, Homo sapiens
  ENST00000514028
gctaaatgaaaggaaaggaaattgtcctatatgcatttgctgtggattcatggattggctttctgtgatagagaaagcttgtttgtatctttggggtcttaaacgtgcatgggaaataccattctaacacactgcttgcttctaagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaa

SEQ ID NO: 12260 - DNA, 3446 bp, Homo sapiens
  ENST00000510942
gcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatccca

SEQ ID NO: 12261 - DNA, 3469 bp, Homo sapiens
  ENST00000506554
acttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagcca

SEQ ID NO: 12262 - DNA, 3347 bp, Homo sapiens
  ENST00000637732
agtcacagacacttgagcacacgcgtacacccagacatcttcgggctgctattggattgactttgaaggttctgtgtgggtcgccgtggctgcatgtttgaatcaggtggagaagcacttcaacgctggacgaagaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagag

SEQ ID NO: 12263 - DNA, 2772 bp, Homo sapiens
  ENST00000514015
acacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagca

SEQ ID NO: 12264 - DNA, 2851 bp, Homo sapiens
  ENST00000629612
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggt

SEQ ID NO: 12265 - DNA, 2247 bp, Homo sapiens
  ENST00000636143
ctccatataagcacagcgtctgagcattcttcaccgatgcttggtggggatattagctgtgttctcttacaccctttagctgtcaagtacatcagaagtggaggctgtggggacaggacaccactaatgccaaccattagtttaaattcacacttggatctgtttccaacatttctgcttttgtcatcatcacagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaatt

SEQ ID NO: 12266 - DNA, 2576 bp, Homo sapiens
  ENST00000636294
gtggacctttcccacaagagccacatttcttcccttggagaattgaagcaaatatgcagaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaa

SEQ ID NO: 12267 - DNA, 2393 bp, Homo sapiens
  ENST00000627659
aaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatg

SEQ ID NO: 12268 - DNA, 1882 bp, Homo sapiens
  ENST00000508569
gtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaa

SEQ ID NO: 12269 - DNA, 722 bp, Homo sapiens
  ENST00000627170
gcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaa

SEQ ID NO: 12270 - DNA, 815 bp, Homo sapiens
  ENST00000627717
ggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaa

SEQ ID NO: 12271 - DNA, 1345 bp, Homo sapiens
  ENST00000503554
attttagtttagctccctgagacatgaaattctcttgttcagtctgtatccccttaacatgccaacatttagtctctttcttaaaattattattttcactcaagcagatttttacttttaatctttaaaatgatgtagaaactactttgaaaaatagcatttctggagtaggatggcttttagtttcaacaaatggaattctgaacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgc

SEQ ID NO: 12272 - DNA, 1182 bp, Homo sapiens
  ENST00000626391
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatga

SEQ ID NO: 12273 - DNA, 1254 bp, Homo sapiens
  ENST00000628656
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatga

SEQ ID NO: 12274 - DNA, 527 bp, Homo sapiens
  ENST00000510980
tgaaggattgtaaatgatagggttggcagagttcatagagacacatgttaaatgattaatttcatgagatttgtaccaagttatctctttatgtggaaaactaatactgaaatctaatatttttaacttttaaaaaaattcatcagtaatgtctttttatttattttaaaagaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctc

SEQ ID NO: 12275 - DNA, 520 bp, Homo sapiens
  ENST00000515715
tccataggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtggtaatacaaaactacattttaaataaatattgataatgttttgtatatgttttgctgtttttatatttgtctaacttgatgaattacttaacattctcccagaaaattaacataacagtgccattgacagagccttgcttgtatttagctattatttctggtaactggtttgcatttcccttttccgtgtaaaaaaaatatatatatatatctggtgaacttcactaggctgatgttctaggataagaaaaacattttcttttaaggctttcaatttatagttggaaaaaaa

SEQ ID NO: 12276 - DNA, 1063 bp, Homo sapiens
  ENST00000513252
catcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaa

SEQ ID NO: 12277 - DNA, 854 bp, Homo sapiens
  ENST00000506716
atgaattagctgccctacttagcatacacagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacct

SEQ ID NO: 12278 - DNA, 100 bp, Homo sapiens
  ENST00000637664
ctcacgtctggtgcaggcaccagtgcagctccagggaaggagtcttgctttctgaagttctgtgtgaggaggaaagcaagggttgtacactgaacttagt

SEQ ID NO: 12279 - DNA, 914 bp, Homo sapiens
  ENST00000631026
gtttgtaaatgagatagcccagtgggagaatgatctttagcatctgtccagaagaaattcttctcgacttgggtctcaaaccactttgccttcatctgcctgcttatgccaaactcaaaatgagcagaagcctgccataatgaagttcccctttttacaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggt

SEQ ID NO: 12280 - DNA, 851 bp, Homo sapiens
  ENST00000502831
aaattgtcctatatgcatttgctgtggattcatggattggctttctgtgatagagaaagcttgtttgtatctttggggtcttaaacgtgcatgggaaataccattctaacacactgcttgcttctaaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaa

SEQ ID NO: 12281 - DNA, 623 bp, Homo sapiens
  ENST00000507984
ctttagcatctgtccagaagaaattcttctcgacttgggtctcaaaccactttgccttcatctgcctgcttatgccaaactcaaaatgagcagaagcctgccataatgaagttcccctttttagaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaag

SEQ ID NO: 12282 - DNA, 609 bp, Homo sapiens
  ENST00000502983
gaagctgcttcctcggtaaatatttccaaactgattagaaagttcatggccccgcgatgaagtcgagatctcaaatactgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagc

SEQ ID NO: 12283 - DNA, 557 bp, Homo sapiens
  ENST00000508610
acatttcttcccttggagaattgaagcaaatatgcagtacgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatcta

SEQ ID NO: 12284 - DNA, 527 bp, Homo sapiens
  ENST00000636541
attaactctctgatttaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagata

SEQ ID NO: 12285 - DNA, 140 bp, Homo sapiens
  ENST00000637372
gggatgtcctgtgccgcaatcttgaagtcattccagatattgctttaacctaccagaacttgtactccttacattttgagacgttgagaaagaagggccttaatggctgtgacagcccagaccccgatgcggacgattcc

SEQ ID NO: 12286 - DNA, 100 bp, Homo sapiens
  ENST00000636517
attaaaggaaacagctcaatctttatcttgggagttcctgactgtctcagaaatgaggaatttgatatcttaagttctcagacgttgagaaagaagggcc

SEQ ID NO: 12287 - DNA, 773 bp, Homo sapiens
  ENST00000503075
cacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatacttcttaggaaaggcagcattttacttcattcattaattgcaccatttacgtcctgattgctgtgcatgtggaatatattgaaagataatattaaagtgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgt

SEQ ID NO: 12288 - DNA, 100 bp, Homo sapiens
  ENST00000637506
gacaaactcagacatcgtggagctcccacagggatgtcctgtgccgcaatcttgaagtcattccagatattgctttaacctaccagaacttgtactcctt

SEQ ID NO: 12289 - DNA, 100 bp, Homo sapiens
  ENST00000637754
gacaaagtgcttctcaagtacacggagtacaacgagccgcatgagagccggacaaactcagacatcgtggagtaacagagcagcagcagccacagatggc

SEQ ID NO: 12290 - DNA, 100 bp, Homo sapiens
  ENST00000637531
caaactcagacatcgtggaggttgggagacaaggaattaaaggaaacagctcaatctttatcttgggagttcctgactgtctcagaaatgaggaatttga

SEQ ID NO: 12291 - DNA, 689 bp, Homo sapiens
  ENST00000511086
acacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggtgagagagcatgcgtggtgagccccaagcctccgcaagcaggggagtttggacctccccctgccacacaca

SEQ ID NO: 12292 - DNA, 125 bp, Homo sapiens
  ENST00000635898
ggagaaaaaagattcagattacgaggattatggatgaacgtaacagacagctttcctactttgaaaggataggagaggtgacatttacaaagaggaaatttgggttgatgaagaaggcttatgag

SEQ ID NO: 12293 - DNA, 573 bp, Homo sapiens
  ENST00000509373
aatttttcataacgggtgaaattgtcacctaatttcattaaaaagattaggaaactttttacaaaaaaaaatacatttcaagtgttagtctttaaaaaagcatagtttgcatcatttaaatgacttgttaaattacttatgagatcattttaattgttaaaaaataaaactacttgatctgctcctgtctgtgatataccatatatttttaacaaaaaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgat

SEQ ID NO: 12294 - DNA, 503 bp, Homo sapiens
  ENST00000515093
gaggatcggcaataattggatggcgttgcagctgttgcgcctctgctgaacgcccagccagagcggattcacttttcacacaaatcaaccggagggattgttgctgcctgcaatcaataactcagcggagtgagttgctcaaactagaggcgtccctcgtctgggtctttgagggccgtccggattgagtcccagcgctctgctttccaaacaaagaagtgggcaccaaaacgcaggacgagatttttaatccccacttccaccacaaccccgggtgccaaagaagagttgcaaactgtgaagtaacttctatgaagagatgaagtaaagaacggaaggcaaatgattgtggcagtaaagaagtgtatgtggaacgaatgcaggaatttgggaactgagctgtgcaagtgctgaagaaggagatttgtttggaggaaacaggaaagagaaagaaaaggaaggaaaaaatacataatttcagggacgagagagagaagaaaaac

SEQ ID NO: 12295 - DNA, 582 bp, Homo sapiens
  ENST00000509349
acacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcataacacttattactggacccacaaacatacctgagggacacggacataaaaattatcctagaggtgtcttcactttgaaaggcagtatttgccaacagattcgttcttactgaattacaaatctcagagatttcctgtttaccagaagtcctcttggagtgcatgggatatagaagcagccattttgagcattcgctttgcaccatcaactgcctagcatctgaaattgaagtcagtcttacataggaacgaatgcaggaatttgggaactgagctgtgcaagtgctgaagaaggagatttgtttggaggaaa

SEQ ID NO: 12296 - DNA, 100 bp, Homo sapiens
  ENST00000636336
caaatattttcagatgtaatttaaaaccaagtaaagaacgaatgcaggaatttgggaactgagctgtgcaagtgctgaagaaggagatttgtttggagga

SEQ ID NO: 12297 - DNA, 100 bp, Homo sapiens
  ENST00000637048
gttgccttatggagtttttgaatggttctgacctgttctcatcaactactacaataacatatataattatcaggaacgaatgcaggaatttgggaactga

SEQ ID NO: 12298 - DNA, 100 bp, Homo sapiens
  ENST00000637801
ggaaaatatcccaaggactaatctgatcgggtcttccttcatgaagcaaacatgtagaaaggggtggacctttcccacaagagccacatttcttcccttg

SEQ ID NO: 12299 - DNA, 421 bp, Homo sapiens
  ENST00000629847
atcaaatatctcattctatttgtagaaaagtacatttagctatgtattctgctactaactcaattctaaaagttttcatcaaaacagtctttaaacataacatttgcttaaaatttggttctcccgtcaaagagacagtaggtggctgttacctttacttcaaattttactaaattttataaaaacctactatttttattaatataattcacacagcattcgaatgtttgactttttttcagacttcttaggaaaggcagcattttacttcattcattaattgcaccatttacgtcctgattgctgtgcatgtggaatatattgaaagataatattaaagtgtaagttttattaaatgttaatttgttttttatttcaataacaaatgagcaatttataataaaaacagttttccaccttt

SEQ ID NO: 12300 - DNA, 432 bp, Homo sapiens
  ENST00000637663
ttgcagctgttgcgcctctgctgaacgcccagccagagcggattcacttttcacacaaatcaaccggagggattgttgctgcctgcaatcaataactcagcggagtgagttgctcaaactagaggcgtccctcgtctgggtctttgagggccgtccggattgagtcccagcgctctgctttccaaacaaagaagtgggcaccaaaacgcaggacgagatttttaatccccacttccaccacaaccccgggtgccaaagaagagttgcaaactgtgaagtaacttctatgaagagatgaagtaaagaacggaaggcaaatgattgtggcagtaaagaagtgtatgtgaaaggaaaatatcccaaggactaatctgatcgggtcttccttcatacttcttaggaaaggcagcattttacttcattcattaattg

SEQ ID NO: 12301 - DNA, 100 bp, Homo sapiens
  ENST00000636061
gtgcaggaaaagcacgctggaatcgagtgctgcagacatcctggaccgtggtttttacgcaaaggaaaatatcccaaggactaatctgatcgggtcttcc

SEQ ID NO: 12302 - DNA, 160 bp, Homo sapiens
  ENST00000635837
gaagagttgcaaactgtgaagtaacttctatgaagagatgaagtaaagaacggaaggcaaatgattgtggcagtaaagaagtgtatgtgcgctccaacctctcagggtgaaaaccgcgacttctgggcgtgcaggaaaagcacgctggaatcgagtgctg

SEQ ID NO: 12303 - DNA, 344 bp, Homo sapiens
  ENST00000503955
aaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtggtgagtgctcacatttgtttttatcatttaccacagagttaccataaaggtaaaactgccaaactccttggccttaggtatttacagaatagacgtgtataacaataata

SEQ ID NO: 12304 - DNA, 100 bp, Homo sapiens
  ENST00000637231
atgggatagaatcaatgttctgatgaacaacatttaacaattttgtgccaaagaagagttgcaaactgtgaagtaacttctatgaagagatgaagtaaag

SEQ ID NO: 12305 - DNA, 100 bp, Homo sapiens
  ENST00000636349
cagaaatcagaacacaggagcatttgtctgtgctcagtatagttaaacactgcttggaaaaataaggtgccaaagaagagttgcaaactgtgaagtaact

SEQ ID NO: 12306 - DNA, 100 bp, Homo sapiens
  ENST00000637167
ttgaattgaaggtttctgtgatatttcaagaaatgggatagaatcaatgttctgatgaacaacatttaacaattttgtaagtaaaggtgccaaagaagag

SEQ ID NO: 12307 - DNA, 828 bp, Homo sapiens
  ENST00000511100
gaggaagagaaggaggaggaggaggaggaggagaaagtggctctcagcggccggtcggattaaaagtaaccagactcgtccagaaaactgcgtccaggaaggaagtgacagaagacgaatgggaaaaggagaacagctcacagcgtttgaaacatcgcggcaccactttcagataaaaacatagacctgaatggcatcatccagtatccaaggaaaccatgcttgcttgaagagtgagcaggtgagcaaagagacaagattacatgtttaaaccaagaaaagaatcttgaaaaagcattgaaaagaacaactttcaagtcaaaagaatcaaggtgaagagaatggatactcatgcccatgtgaatttgctgccccaagtctactggaggatcaagctgcaggtttcaatagctatagcctgaagaatctctgtaatgaactaaaacaatcagtaaaagatcagttgcagtggaagacattatactctagatttttctagtattattaaatttgaaaatgatttattccaaattttaacttagcttttaattttactagtgtcaaaatgttgtactactttggacaactgatttttccaatagagagtcaatagcatctttgcagggtggtttaaaagccaataatttaatccatattctactaaaacttttaatataagcattttacccagatgtattttttccttgttttagaaaatctgattttaattgctaaaactcgtttttaaatattaattcaatgaaagaaatgctatggttttctactttttcatttcttaaactcaagggaaaacatgggtgaaaaaca

SEQ ID NO: 12308 - DNA, 2350 bp, Homo sapiens
  ENST00000514794
agactcgtccagaaaactgcgtccaggaaggaagtgacagaagacgaatgggaaaaggagaacagctcacagcgtttgaaacatcgcgaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgcccccttgatcgtcaagccgtgagatgcgtgatctctctgcacaagtgtctggcaggccgagggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctaggtatgggtgggatttgtttcttctagcagttgtaggttagccacatgggtacgtgctgtcgcaccacacaacaaaattttctctataataaccagtctaagtaggcttttaccccacaaaagtagatcccatttaatttactttgtgtttatagcactccctctcaaaccgcaccattggcacagactaatatttatacaactttttattttaaactatttatttggagttgagacttcagtagcactccctgtcagattcattgaacaagcttaaattcaggatactgaaaatgtaaattgggaagagggatgtatgttcttgggattcttttctcccgtgcatggacacccaaacaactctcactgtagtaaagggaggttacacatgtgttgataacatttgtattactgctggtaggaaattgaacattgatgggtggttttaaaagcctgcttttgcctattgtgtttccacatttctttgccaatatagttggtcaaattagttatgcaaaatgcatctaaaaacttctaatccaaaagtgtcaatgttgttaaagatttcttttcatacacaaagaaatattacattgctccattattttaatggaagtcgttagtcaaatacgcttttgccacagaaagaaaagggaaaaaattcttaattttgtatctgacctctgctttggggccttactttaagttacatttttcttaaataaagcttttctgttttttaaagtgaatgacgggatgttaactttaaatagacatttaaccacataaagtatagtggcagatggttcatttttctactcagggtagacactttattcaggtaatgatatttaatcctcattttctatgaaatctgcatgttgttcttaaatctgatactattttgtgatttaaaatgagtgttgggttaactttgtttacaagtgaagtatttatccctttgattctcttttactttcttcttttggtaaacacctatccgtttctaagacccacttatatgttatctcatcaaggaaaattttcccatcctcccaaaggagaacagaactccactgtagtggaataagttttttgaggtatgaaccaatgcttctgtcctcctaatattcttacaacctctaacccgcctctgcattcaggaaaccagaatacattagggaggagacagcaaaggaaaacaaaagacaataaaggaatcgatgtatttgttttgtaactcaaagttaaagtccaaatttagaaaatagatttgaaagcataacgggtcaatttctgttgtgcctctgaagaagaaagttgagaaagaacgaagagggcttagatgctggtgggtgtctgcaaaaaagcccagacaatgcctggaataataaagaagcagagaacttccagggaggaagggaacagtctctaagatggagcaggacctggggaagtcttgcttctccactgaagaacatggaccaagaccagggcagaagggatggcagcttccccgtagagcagtgaggacggatgacgacatgaagactggactgctcattctcaccttcccttcacagtccctggcactttttaagctccttggaaattagaggcaatctaggagaaagggggatagaagcagaccttatttctgttacaatgtgaatgggagcttcaaattgaagataaaatgttatggaaaaagtgaaattatatatatattttgcacatcgtagcttggtggctttaggtttctgtgcatcaaaggaaggaattgtgtcttcctcattgtcatactctggtattggagattgtgcaacatatatagtaggtatgcaataaacagctgttaacagaatgaatcaa

SEQ ID NO: 12309 - DNA, 741 bp, Homo sapiens
  ENST00000512585
gcgtccaggaaggaagtgacagaagacgaatgggaaaaggagaacagctcacagcgtttgaaacatcgcggcaccactttcagataaaaacatagacctgaatggcatcatccagtatccaaggaaaccatgcagttttgaacatctggaggcctgatttattggagattgcaaatgtacagtgtaacatagctgtggagagcgagaagatcaggattgtcaatgctgtcattgcttttactggaatccccagcacgaattgaaggtttgaccagagacaaagaagcaaatgctatcaattaacattcacatgtggtaggaattctactagtgcatgtggagagaaacatggctgctgcatggagtcataaacctcagaggaagctgagaatgagatgaaatgtatatgtaacccttgtgtatggcaagtttggcaagaaagaaaaagcatacttggcagattaagataaggtttctctctgtttactgatatagtctcaggtttgcattgtgtgatgaataataggttgggggaagatatcctttgtttattcattcatttcatcaacaaatatttaatgagtacctactatatgccatgccacaaagagtataaacctagagacagaatgttgagtcacatagacagtgctcctgatacaattatttgaactgagttaacaatacttcaaggttccatgtctaatttactggctaggttctcaacaaaatttctggata

SEQ ID NO: 12310 - DNA, 563 bp, Homo sapiens
  ENST00000513704
aattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtaggggggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctaggtatgggtgggatttgtttcttctagcagttgtaggttagccacatgggtacgtgctgtcgcaccacacaacaaaattttctctataataaccagtctaagtaggcttttaccccacaaaagtagatcccatttaatttactttgtgtttatagcactccctctcaaaccgcaccattggcacagactaatatttatacaactttttattttaaactattt

SEQ ID NO: 12311 - DNA, 1754 bp, Homo sapiens
  ENST00000514011
ctgctctcatcacctatatactcttctctctgcccgtctctgcttccccccccttccccccccccttttctcccggccgacggagctgaaggggcgggggttccttccttggagtgtttctagagctcggaggctgctggtaggggggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctaggttctctaaacatgaatatgcctttgggggaagacagaagaacatggaagccatgtgaaaaaaacggatcctaaggtataaacaaagtgcagatgattgtcggccatgctgcagggatttcttgtttgtcttctcagtagtgttagctaattttgtcttccaatccgcaattccttataggacttggacgctttgaacctctcaggacccctcagattctagtacataaactcggagccaaattcacagccagctctccttcaaactgccttatctgtttttgagttaattagaagggccttttaacaactttgcatttgagtcctaagaaaagtctagttcattaggcaataaagccactgtgctggcccctaatcaaggtcagtacatatcattatacgactgatccaaatttgagttggttcagttatttcatttgttcattgtccacaatgttccagtcacagtaccaggtgctcagagtgtggtgttagagacaagattcaaagtaagtaattttagaccaatgtcatatgcgccattatagaagtacggctgaaaatggaatttatataaataagcatgtgagtggttcactaaacagggatgggcaagaaagaccttacagaagagatgaatatcttagcgaataacttagcaggatttcaaagaatggacgagagttttgcaggcagatgagataggaagggtgccagagagaaaggaaagcatgggcaagggctcaggaggtggggaaaaatgtgatatagtttgaggtactggagtatgaagttaacaaggggagaatatttagaaggaaggatggagaagtaggcagagagcagattatcaggttaaaatattagaaattagtattgaagtttactagaagccagcagcacgttcaatgcaagcaggtgccatggtcatattagttttagtttagtaatcagtgtagaaggtggatgagagggggtgagtctggaggcaataagcatagttggtagtagcagtctaggtgtcacctgacaggggcctttactagcccagtggtggacatttttaatgcattagtctttcttctagtctgtgaatttcttataacgagggtgtggtcttcctcacacttgtttcttcacacttgttgcctactatcatacctgacatgcagtaaattaccatagcaagacaaaaaatctcttaaacgtgtactctttattactctgttggaccatgatgagagcaacttattgtatggctatttaaaattatttatgaagataatattttttgtgttggaaatgctacaataatttaattgtgagatttataactaagacttattgttcacatttgttttatgttttcatatatgtgatgaaatagacaatttactctgtaagtcttaaatataaaaatgattcattatttctttctga

SEQ ID NO: 12312 - DNA, 388 bp, Homo sapiens
  ENST00000509179
ctgcttccccccccttccccccccccttttctcccggccgacggagctgaaggggcgggggttccttccttggagtgtttctagagctcggaggctgctggtaggggggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctagacatgacaaactccaaaaggaaacccaagcagctatttggctcccttaattaatgaagtcgcccagtatggataattcaggttctctaaacatgaatatgcctttgggggaa

SEQ ID NO: 12313 - DNA, 501 bp, Homo sapiens
  ENST00000514092
ggagtgtttctagagctcggaggctgctggtaggggggcaccactttcagataaaaacatagacctgaatggcatcatccagtatccaaggaaaccatgttctctaaacatgaatatgcctttgggggaagacagaagaacatggaagccatgtgaaaaaaacggatcctaaggcagttttgaacatctggaggcctgatttattggagattgcaaatgtacagtgtaacatagctgtggagagatctcacatgagatggcaaagaggtcaagacaaaaattctgcatttgggaaaagaataacacatggacttcctcctacaggattataggactgtgtatgtcctacacacacattatatgtcctacacgcacagtgatgaggagtgacaaaatgaagactccagaatcctctttatcagatcctgaatgtgcactttctgaagtgaagtccactatgtgctgggcacacagagaatagagcatgaaacaaaagcaaca

SEQ ID NO: 12314 - DNA, 358 bp, Homo sapiens
  ENST00000511876
tttctagagctcggaggctgctggtagggggaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgcccccttgatcgtcaagccgtgagatgcgtgatctctctgcacaagtgtctggcaggccgaggtgcacctgtttctgtcactctggagtaaatttagctgtaaagggcaccactttcagataaaaacatagacctgaatggcatcatccagtatccaaggaaaccat

SEQ ID NO: 12315 - DNA, 483 bp, Homo sapiens
  ENST00000508718
ctagagctcggaggctgctggtagggggtgcttgtagacatggaagaaggcctcaccttctccatggctgacaaccgagaaggctggtctgacttggaagaagctgtgtggccaacagccaattggctgtatcacatgggcaccactttcagataaaaacatagacctgaatggcatcatccagtatccaaggaaaccattgtgtctgtaaccagctaatgagctgcaacagagcctggccttcattttcagcaaattaagttcatccctcataggaattgtggtctggctgtggcaccgctcctaggtatgggtgggatttgtttcttctagcagttgtaggttagccacatgggtacgtgctgtcgcaccacacaacaaaattttctctataataaccagtctaagtaggcttttaccccacaaaagtagatcccatttaatttactttgtgtttatagcactccctctcaaaccgcacca

SEQ ID NO: 12316 - DNA, 713 bp, Homo sapiens
  ENST00000514158
ctcggaggctgctggtaggggggcaccactttcagataaaaacatagacctgaatggcatcatccagtatccaaggaaaccatgcttgcttgaagagtgagcaggtgagcaaagagacaagattacatgtttaaaccaagaaaagaatcttgaaaaacagattggaagaatgcgaaatgttattagacacaggcacagcatagcagtagaaacatcttaactgagaacttggaactgaaagagaaagcaaccaacttaaagggcagacaagacacatggttatgtaacacagcagtgggtattcacagtgatgacacaagacaaaacaattacattttcattctaaaagtaatttttaaggaggcaagggcatttataaaacattttagaaactatttaataaaaatggtaaaattaaagtgtttgtttatgtactcaacaaatatttatttggaaagtgcatgcctgggggcacatctcgttaatgaggtgatcctgtgtttagaactgaaggcagtcctcatccattctctcaaaaggtgaccttctttgttcttcttatagcctcaccacatttaattttcagaggttttgacataaattaaaaacattctttggtagattgtattgtatgaaaacaatcttcaaaagtgtaagcattgatatctggaatatctgggaaaatgtacaataaagacatctcttctggtctt

SEQ ID NO: 12317 - DNA, 362 bp, Homo sapiens
  ENST00000506665
gccaattggctgtatcacatggaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgcccccttgatcgtcaagccgtgagatgcgtgatctctctgcacaagtgtctggcaggccgagggcaccactttcagataaaaacatagacctgaatggcatcatccagtatccaaggaaaccatgttctctaaacatgaatatgcctttgggggaagacagaagaacatggaagccatgt

SEQ ID NO: 12318 - DNA, 542 bp, Homo sapiens
  ENST00000639552
aaactattgggaatctaggatgccactggaacatgtaaaatggcagctaaggtctatggaaacccttcatgtttagaaactggctaaagcttgagttctcttatcttttggttaagggcaccactttcagataaaaacatagacctgaatggcatcatccagtatccaaggaaaccatgcttgcttgaagagtgagcaggtgagcaaagagacaagattacatgtttaaaccaagaaaagaatcttgaaagtaagtgtaatgaccaagatgcaaaaatctgtttggggaaattgttgggaggttggcacatcattttctttatcccctccccacaaactaatgtacatttctgcagctaatatcaaagttttaattcatgttcaggagctatgaaatctactgtggaaatttagtttctaaacaacatgctactctggagaaagacattcctaaaatatttgaaatttctactatttccgtacttcgactttttttttgttatttgtactatctccttttaaaattaaattattttcaatgt

SEQ ID NO: 12319 - DNA, 427 bp, Homo sapiens
  ENST00000508521
ataggaattgtggtctggctgtggcaccgctcctagacatgacaaactccaaaaggaaacccaagcagctatttggctcccttaattaatgaagtcgcccagtatggataattcaggttctctaaacatgaatatgcctttgggggaagacagaagaacatggaagccatgtgaaaaaaacggatcctaaggctttttacctgtctgttgaactgagtgaaggacccagaggccctatgatgtggtgtagcttcgagagaaggaagcctagatccctgaatcattgtgcagaacatacttatcctacagccatataggactgttatatgagtaagcgctgaagttatttcttaggttattgaactttccaagcatatctattacattaattagtgttacctcaataaaagcatgtacttcacagaac

SEQ ID NO: 12320 - DNA, 594 bp, Homo sapiens
  ENST00000514571
cagaagaacatggaagccatgtgaaaaaaacggatcctaaggcagttttgaacatctggaggcctgatttattggagattgcaaatgtacagtgtaacatagctgtggagagcgagaagatcaggattgtcaatgctgtcattgcttttactggaatccccagcacgaattgaaggtctcactttgccacctaggctggatgcaatgcaacggtatgttgatcttggttcactgcagcctcaacctcctgagctcatgtgatcctcccacctcagtcccccacgtcgcttggattacaggcctgtgccaccacacctggctaactttttttgtaatttttgtagagacagggtctcactatgtttcccatgctggtctttaatgcctgagctcaagccatccgcctgcctcggcctcccaaattgctgggattacaggcatgagccaccatgcccagcctaattcttctaaatcttatcctagtaattaagccagaatttttctctgccaagaccaatagatggaccaagaagtactcatccttgtaaactttctttggataaattgcttacatataataaattcagagttaag

SEQ ID NO: 12321 - DNA, 679 bp, Homo sapiens
  ENST00000508742
cttcctgttgtcatgtgaaggacatgtttgcttccccttccaccgtgattgtaagtttcctaaggcctccccagccatgctgaactgattataggactgtgtatgtcctacacacacattatatgtcctacacgcacagtgatgaggagtgacaaaatgaagactccagaatcctctttatcagatcctgaatgtgcactttctgaagtgaagtccactatgtgctgggcacacagagaatagagcatgaaacaaaagcaacatgaccctgccctcaccaagactacagggagtgatggagcatacaactttgtttcagaatgcaattcagatcttccctttcgcttggcttcttaaaacttcttttgaggatggtaaaatttcgtgttatattaaatttcatcctgtaactgatactctgggatgatgttggccaataactagcaagactttaaataatcaactagtttaggcattgcttagcacgctccagctgacttcacaagtaaaaccatgtgaagaaagaaggttttcaggtaacacagatggaggtgatgatctttctcattttgtggaaaatattaatttctcattttttattcactgacaattagtaaaattccttactctacctaatatgtagacttctgaactatgtaagtaaaactttatagtaact

SEQ ID NO: 12322 - DNA, 498 bp, Homo sapiens
  ENST00000553584
ggtctgaaaaatgatattcattgtcctaatgtgtaaatttcgacaatttgcaaatttgtagattctttagaatagaactaactcaagcccttcattctgcagctgaggctcactgcccccagtgggcagtgggtccagggggtttctgaggacagggcatgacccagccctgctgcccccaagatggcacctggcttggaggggtgaggggccctgttagtctgactttgaagaagaccagccttccagactcgcttggtgccctgacaggagccctgggctcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctc

SEQ ID NO: 12323 - DNA, 557 bp, Homo sapiens
  ENST00000554852
cagtgggcagtgggtccagggggtttctgaggacagggcatgacccagccctgctgcccccaagatggcacctggcttggaggggtgaggggccctgttagtctgactttgaagaagaccagccttccagactcgcttggtgccctgacagcagcttgtgtttcttccttcaagagtctgcttagagataataaagatcaacactattccttataacaacacctcagtatcctgcgagctgtacacaccagagtttatttaaccaccttgctgctggcatgaaagcctcaggagccctgggctcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctcgaggtcggctaggaagcaagacccaggattccaactca

SEQ ID NO: 12324 - DNA, 1369 bp, Homo sapiens
  ENST00000636052
cttggaggggtgaggggccctgttagtctgactttgaagaagaccagccttccagactcgcttggtgccctgacagcagcttgtgtttcttccttcaagagtctgcttagagataataaagatcaacactattccttataacaacacctcagtatcctgcgagctgtacacaccagagtttatttaaccaccttgctgctggcatgaaagcctcaggagccctgggctcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaatgataagtctacttttcttccacgtaacaaccacaggatagatgacattcattttctaagaaacaaaatcttggcagttagatccgtggggtaaagaatatagatactaataatgaaaaccatgtagctggtcttattattctctaatcatgaagaccattattgttatttgtggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgataaggaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaagtaaataacagtccaaaaacttgtcaattaggaatgaatgcgcaatgattcaattattctccagcgaggaagatcatg

SEQ ID NO: 12325 - DNA, 1176 bp, Homo sapiens
  ENST00000553465
caaaagatcatgattaatccagttctgcacaaaacactgaggtccattagaagacaataggtcttggctgtttcattccttttaagagctgtttaatattccacggagccctgggctcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaatatgaaaaataaaagaaatctacatggatcccactttggacaaagtgcgtgtcaacagttgcatgaaatggtatttcacttcttgattattgtttgtttttattctttttttagaaaaaatgaataaatgatcaaattattttgggggtaattaaataaaagaaagaacacaagtgagtcagtaaatgcttaaattaaggtagatcttggatcattgcttcatggcacactctcagaaatgctcaaatatggtgccttaaaaaaattaatgaggtttgggtgttgatgtggttagggagtatacagatagatagttgttagtggttacatttattactcttgcattgggtggatttaagggttcattatattaagaattaaacagtaagtaaattcatacataaaaggtatggttattcttgagtcaataatgagaatgtgttaggaaccaaggtttatgattaatctaaaataatttctaaaagaagttaagtctttgctgtttcgttctttctaaa

SEQ ID NO: 12326 - DNA, 286 bp, Homo sapiens
  ENST00000554323
accatctatgtagcattccaatattcttgattgactcataaatttcttttacagttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagat

SEQ ID NO: 12327 - DNA, 480 bp, Homo sapiens
  ENST00000556475
aggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaatgataagtctacttttcttccacgtaacaaccacaggatagatgacattcattttctaagaaacaaaatcttggcagttagatccgtggggtaaagaatatagatactaatgtaagttaacacctcaagttcatgtccttggtttggatgctttgttcaggagtgtttagtggtatttcaaaggaatcaatatctataacaaattaaaataaccaggaatggaccagtg

SEQ ID NO: 12328 - DNA, 439 bp, Homo sapiens
  ENST00000553421
aaatctaggttttttcatcctttttaatatcagccttgtgttccacagaatggaggctccagagtgaaattaatgacactttgtcgatgaagatcttgattgtgacctctgtggaaaatgagccatgaaccaaccaataagcaggcttagtcacccttgacacagtttgcagttatccacctcctccaagttcttaatatgttagatccagataactgccttgtacagccacctccaggatactgcctccctaaaaaacagctagatacactgaccccacagcctatgtggaccacacagatatagtggcttgctctaaatgcaccagtgagaactctctgcaggaaacctgcttgggaaatgccatagcctgcaatacaggctttccccttcccgctggccctgtgaggcatgcaggatctgtaagtaataaactgct

SEQ ID NO: 12329 - DNA, 3757 bp, Homo sapiens
  ENST00000638012
ggaccaatgatgagtaccatggggtatctgaaacaggatttttgattaaacccatatgcaattctgaggtccattacaaagagacacgtattattccttttttgggaagtgagcctatggtaccttttccttggactttgtggttcttggggatggattgcatttttgttataaaatcagcccatgaattaaaaatttatcaatgagtaaaacataaagcataagtcatgtacttattatcagtgactgtaatgaaacatggattattattaaaacttatctgagactcccaataaattaatacccaaggcttctaccattctggtaaggagcatatggtcatttgtatgcaagagtcagtttttgttctgtgttggtggtgggttgctgactattttatgaagaaaatgaagcatctttaatcatataaatagttggttaaataaccacttaattgagaccaagcagagaccaatgatgagtgtattaatctattttttaatggatttttattaaacaaataataaaagaaacacagtctattcttcctgagggcaataactctagacagatgtaaatattcttcagtgttcttgtccagtgctgtgagatcacagatactgatgtcttttgtatatgagaaggaacttgcatttttatgtctcagtttatattttagagtcagcaaaccatggaccaattaggaacaaatgttatgatatgagaatgctgattcttgtttttttttttcatgatagacattctaagaaaaactctaggctctctcattgtttttggaatacatacatggttctttccaagtagtttcttagaaaaatgtttttaaaaagaggcttttaaaaagagccttttaaaatgtttttaaaagaaggctttatttttctctatagaatgaaaaccatgtagctggtcttattattctctaatcatgaagaccattattgttatttgtggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgataaggaatagacgagattggatttggtcatttccccaaggtgaagagcatggcgatttcttctgtggtaaggagcaataatgaagaccatggttgatttaatcagtctctgctgatgaagatcttggctgttacctttgtgtaatgaatgcgcaatgattcaattattctccagcgaggaagatcatggttgttgtctgtttgagtaatgagtgtagaaacctataatggaggcgtgatggctgatgcaatcattttccactgatgaaggttttgatggccacctgtaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatggttgatgttcatgggtgattgatcatcctgtagcgacggtggtattgactgttccccagaggacaaggagtgtgttcttatctactcaggaggctgaggcaggagaaacgcttgaacccgagaggcggaggttgcagtgagctgagattgcgccattgcactccagcctgggcaacaagagtgaaactccatctcaaaagaaaaaaaaaagaaaacaaaacaaaaaaagaaaaaaccaatgttccaatagtttcccaaatcatgctgatgctgcctcctgagaaatattttcagaatcactgagaaaaatgtatgaaatagttaatgtccttgctctgtgtcagtggtggaggctgtctgcagtaggagcatggagaccaacaatggatgctcttaaactgatttaagcacgcttccatggtcagaagccttatggttgccacagggtattaggagcatggagaccaataatggatgtccttgttctgatttgaggatgcctccaaggtcacatactctgtttgcaccacgcttaggaaggagcgtgaagaccaagggaagatgataaacacagatcatggaggactgttttatctgtttgtgatctgccgtcctctgtgagcctcaggatggatgtttgccagccgattccatggttacaagctctatagctgcatctatgtgttaggagcatgaagaccaataatggatgcactgagctgattatgaatttagccctgatgaagacttgtgttgctgtcatgatatgaaagattccagtaatgaacgcacttgagttgattcaagcacgcttccatggtcatgagctctgtggttgcatctgtgtgttaggagcatgcagaccaatagtgataatctcgaggtgatttatgcattcttccatggccaccagccttatgattgcatctgtgcgtcacagcttagagatcaataatggatgcaacaagctctttgaatcattctgttgggatcaagattgttgtgttccctctgtttggaaagagaccaagaatggatacgctcaggtgatttaagcagtcttccatggccacgagctctgtggttgcctctgtatattaagagcacagagattaaaaatgggtgcacttgagccgattgaaacattcctccttgcatctttcttctgtgattgcatctatttgttagtagcatagagaccaataatagatggcttgtgctgatggaaggattcctccctggtgacatgctgtgtctgcctcttgattgggagcacgcagacctacaatgatgcactttttatgatttgagaattccttcatggtcacgtgctctgtttttatcatggttgggagcctgcagagcaataagggacatgcctttgctgatttgaggattcctctgaggttgggagctaagtttgcatcatgcttagaaaggagtgtgcagacctgtaatgattgcactttgctgattgaaggattccttcaagtccatgtgctccacttgcaccatttttaggatggagcctggagacctataatgaacaacttgtgctgtgttaaggattcctccatgatcacgcgccccatttgtacaccatgcttgggaaggtgcatgcagaccaatgttagtaatagtcaaaattcctgtgtcggtttgtgtggtttgctaaacaggactcaatgtatcatgaaacagtgtattatatagtcaactatggtcaactatgtcccagtgatatttatgagagggatctgaagtatttattgataatgcatatatgaaaaacggagaagaattaatgaaacagatatatctgtgttagaatgattctgtataaagatagggaatatcaagt

SEQ ID NO: 12330 - DNA, 456 bp, Homo sapiens
  ENST00000556720
agaatgaaaaccatgtagctggtcttattattctctaatcatgaagaccattattgttatttgtggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgataaggaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaaaatgaatgcgcaatgattcaattattctccagcgaggaagatc

SEQ ID NO: 12331 - DNA, 469 bp, Homo sapiens
  ENST00000555354
cataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtaatgaatgcgcaatgattcaattattctccagcgaggaagatcatggttgttgtctgtttgagtaatgagtgtagaaacctatgtaagtaacaaagtgattgcttttgctttagtggttgttaagagagttaagtctttctggaaaggaataaatgactatgtatacaaataaa

SEQ ID NO: 12332 - DNA, 541 bp, Homo sapiens
  ENST00000554485
ctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaa

SEQ ID NO: 12333 - DNA, 644 bp, Homo sapiens
  ENST00000427085
gttgtctgtttgagtaatgagtgtagaaacctataatggaggcgtgatggctgatgcaatcattttccactgatgaaggttttgatggccacctgtaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcactggagctgatttaaacattctttggtggtcacaagatgtatagctgcctctgtatgtttggcgcatggaaaaaaatatgagtttttgtggacatacactctttatttgaaaagtatgaaatataatccaagaaagccagccatggctcagtgataaatatggaattgatatgaaacattatattgattaatcacctttgaggatgattaataaaagagagaaagtgattctatatagagatgcaggactatttcaggctcattcatgatctaggtttttgtgcttcatggttattttattatcatcaataaaaagaaaaaa

SEQ ID NO: 12334 - DNA, 800 bp, Homo sapiens
  ENST00000414488
aatggaggcgtgatggctgatgcaatcattttccactgatgaaggttttgatggccacctgtaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatggttgatgttcatgggtgattgatcatcctgtagcgacggtggtattgactgttccccagaggacaaggagtgtgttcttatgtaagtcatagttgacattcttgtttttgattgggtagtttgcctgttcattgatgttcatagtactatagaaggtagataaatggccacatacctaaagaaaatcaaaggggacaaaaagtgagagtctgttataaactaaggattataattaatgtaattcagtacaactgtggacaattttgaaaagataaagattgatgtcat

SEQ ID NO: 12335 - DNA, 737 bp, Homo sapiens
  ENST00000434716
aggacataggctgctaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatgtgagtaatggttcttgtcttggtttaggttgtttaatggtattcctgatattattaaaaattatttaatataataaaaagttaattggcttaatgacaatgtgcaacattgaggttaattaatgaaagagatgtagtctctgtgggaaattattgtatagacaaatgtaaggattcttcaaatatcttgttcttgggttttcaaaatcatgtattcattttattatcaaagaagaaatgatttattcaataaatatttagaaatgaatgatg

SEQ ID NO: 12336 - DNA, 485 bp, Homo sapiens
  ENST00000554369
gatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatggttgatgttcatgggtgattgatcatcctgtagcgacggtggtattgactgttccccagaggacaaggagtgtgttcttatctactcaggaggctgaggcaggagaaacgcttgaacccgagaggcggaggttgcagtgagctgagattgcgccattgcactccagcctgggcaacaagagtgaaactccatctcaaaag

SEQ ID NO: 12337 - DNA, 924 bp, Homo sapiens
  ENST00000556637
gatgaggagtgtgaagcatgtccactcaatgtaaatggtgagacaacagaaatcattaaaatgtattgaaaatatgaataccatttaaaaaacgaacaattcaagtgtaatctttgactacggatgacataagcagtatagtgaagtttcttattttgcatcagaacaagtgtgctgttgttcatttttttaaaagaaaattgataagtattaccacaattaatagatacctgaatgactaagagaagggtcaaatgaatgaatccgtgaaaaatatttcaatcctgttaccttctctgctttgcacttcccagaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatggttgatgttcatgggtgattgatcatcctgtagcgacggtggtattgactgttccccagaggacaaggagtgtgttcttataatggacatcatgattgggattgtctttattaaactttgtcaggagagtaaagatcaatgtggccacatgttgtggctcatgcctgtaatcccaacactgtaatcccagcactgtaatcccagcctgtaatcccaggctgaggtgggcggatcacctgaggttgggagttcgagaccagcctgaccaacatggagaaaccccgtctctactaaaaatacaaaattagccgggcatggtggcgcatgtctttaattccagctactcaggaggctgaggcaggagaaacgcttgaacccgagaggcggaggttgcagtgagctgagattgcgccattgcactccagcctgggcaacaagagtgaaactccatctcaaaag

SEQ ID NO: 12338 - DNA, 480 bp, Homo sapiens
  ENST00000443252
ggttgatgttcatgggtgattgatcatcctgtagcgacggtggtattgactgttccccagaggacaaggagtgtgttcttataatggacatcatgattgggattgtctttattaaactttgtcaggagagtaaagatcaatgtggccacatgttgtggctcatgcctgtaatcccaacactgtaatcccagcactgtaatcccagcctgtaatcccaggctgaggtgggcggatcacctgaggttgggagttcgagaccagcctgaccaacatggagaaaccccgtctctactaaaaatacaaaattagccgggcatggtggcgcatgtctttaattccagctactcaggaggctgaggcaggagaaacgcttgaacccgagaggcggaggttgcagtgagctgagattgcgccattgcactccagcctgggcaacaagagtgaaactccatctcaaaagaaaaaaaaaagaaaacaaaa

SEQ ID NO: 12339 - DNA, 823 bp, Homo sapiens
  ENST00000423708
agacaagagcctccatggtgtctgcctgtataaccaagttttctatgagagggacaatgggtcatagattgaacacttgggcattacatctgtgagaataagtctatagtaaatttcagtaaatttgagggatctaattatggggtttcagtagatcctggggatttattgcattattcgaaggaaataaatgaaagaatcagcaaaacatacagacacacatataaataattaaagatgaagaggataaagctggattaattgaggaaaatgctatcagacaggaatttttggttctgtaattctgaaacactgcaatgcattaagaaacctgtacatcaagggtgtcacctgtctagggtagggtaatatagagtagttgttctcaaatgcgagcattggagtgacctggagggcttgtaaaatacagaaggtcacctacattctcaggatttctgattcagtaggtttggtgtggggtctgagaatctaaatttctaataacttaatttctgtaggttccaatagtttcccaaatcatgctgatgctgcctcctgagaaatattttcagaatcactgagaaaaatgtatgaaatagttaatgtccttgctctgtgtcagtggtaagttccagtttgtttattttattgagaaaaagaaggtaattaattaattaagcaattaatatttatttatttatatttgagatggagtctcactctgtttgttgcccaggcggaggttgcagtgagctgagattgcatcattgcactccagcctgggcgacagagtgagactccatctcaaaaaaaaaaaaaaaaa

SEQ ID NO: 12340 - DNA, 625 bp, Homo sapiens
  ENST00000442197
gttccaatagtttcccaaatcatgctgatgctgcctcctgagaaatattttcagaatcactgagaaaaatgtatgaaatagttaatgtccttgctctgtgtcagtggtggaggctgtctgcagtaggagcatggagaccaacaatggatgctcttaaactgatttaagcacgcttccatggtcagaagccttatggttgccacagggtattaggagcatggagaccaataatggatgtccttgttctgatttgaggatgcctccaaggtcacatactctgtttgcaccacgcttaggaaggagcgtgaagaccaaggggagtaatagtcaaagtccttacctttgtttgggtggtttgtttaagagtaatcaacgtattatttaaaagtgtgaaatacagtcaaagatggccaatgttattccagtgatatgggagtgacatgaagtattatattgatgatgcatatataaaaaacaggatagttaatgaaacacccaatgtttgagtgattctgtatactgatagggaatatcaagagtgttactgggttttgtgaatcacgggccttgaaagtattattaatgaataaatgacataatcaatagacaaggtagaaatgaatag

SEQ ID NO: 12341 - DNA, 2155 bp, Homo sapiens
  ENST00000636391
aatggatgtccttgttctgatttgaggatgcctccaaggtcacatactctgtttgcaccacgcttaggaaggagcgtgaagaccaagggaagatgataaacacagatcatggaggactgttttatctgtttgtgatctgccgtcctctgtgagcctcaggatggatgtttgccagccgattccatggttacaagctctatagctgcatctatgtgttaggagcatgaagaccaataatggatgcactgagctgattatgaatttagccctgatgaagacttgtgttgctgtcatgatatgaaagattccagtaatgaacgcacttgagttgattcaagcacgcttccatggtcatgagctctgtggttgcatctgtgtgttaggagcatgcagaccaatagtgataatctcgaggtgatttatgcattcttccatggccaccagccttatgattgcatctgtgcgtcacagcttagagatcaataatggatgcaacaagctctttgaatcattctgttgggatcaagattgttgtgttccctctgtttggaaagagaccaagaatggatacgctcaggtgatttaagcagtcttccatggccacgagctctgtggttgcctctgtatattaagagcacagagattaaaaatgggtgcacttgagccgattgaaacattcctccttgcatctttcttctgtgattgcatctatttgttagtagcatagagaccaataatagatggcttgtgctgatggaaggattcctccctggtgacatgctgtgtctgcctcttgattgggagcacgcagacctacaatgatgcactttttatgatttgagaattccttcatggtcacgtgctctgtttttatcatggttgggagcctgcagagcaataagggacatgcctttgctgatttgaggattcctctgaggttgggagctaagtttgcatcatgcttagaaaggagtgtgcagacctgtaatgattgcactttgctgattgaaggattccttcaagtccatgtgctccacttgcaccatttttaggatggagcctggagacctataatgaacaacttgtgctgtgttaaggattcctccatgatcacgcgccccatttgtacaccatgcttgggaaggtgcatgcagaccaataatggacgtacttgtgatgatttaaagatgcctccaaggtcacgtgctctgtttgcaccatgcttaggaaggagcgtacagaccaaaaatggatgaattgtgcaccttgaaaagttcttccatggtcacctgaggcatctgcgtcatgattaggctccggatgactaataatggacgtacttgttctgatttgaggacttcttcatggtcacatgttctgtttgcaccatgcttaggaaggagcatgtgtaccaataatggaagcacagaagctggttttaatagttaagagctgtatggtccatctctgtgctagaagctggagaccaataacagtcactccctgcactgattctgccatgaccacttgctctatggttgttttaaggaacctacagacaaataatggattatcattggtgaagatcttagctgttccatagaaggaacacacttatcactacagtgattctgtaatgatgaagacctttatgggtcagtgatgggtagaccagagctgattaaattattctcccattgatgaggaactttaccttatccctcagagtaaggagaatgtcatataatgaaagatactgatctctgttcttggttaagttccaagaaccatctaagtttcgtgcccctcagctgtaaaagggaagtacatttcatttgtttattctgtaaaactctcggtgtgtgccatggccatgcactgatgatgagcacatgtgtgcggcccctgcccccgtggagcgcatgcatggtcctccagccagagaccgcgctgggagaaatcaggggttcactcctggtcggaggagcaatccatcagtcatcctgcccagagcttgtgaaggtgcagtggcctgagccaggcttccaagaggacaaccgtgatgggctctgtgtgcgttgctgggaggacttttcaatgtgatggcagcctgggggaagacagtgtcaccacgacagtgtcacggaacatgcag

SEQ ID NO: 12342 - DNA, 1634 bp, Homo sapiens
  ENST00000554693
cacagatcatggaggactgttttatctgtttgtgatctgccgtcctctgtgagcctcaggatggatgtttgccagccgattccatggttacaagctctatagctgcatctatgtgttaggagcatgaagaccaataatggatgcactgagctgattatgaatttagccctgatgaagacttgtgttgctgtcatgatatgaaagattccagtaatgaacgcacttgagttgattcaagcacgcttccatggtcatgagctctgtggttgcatctgtgtgttaggagcatgcagaccaatagtgataatctcgaggtgatttatgcattcttccatggccaccagccttatgattgcatctgtgcgtcacagcttagagatcaataatggatgcaacaagctctttgaatcattctgttgggatcaagattgttgtgttccctctgtttggaaagagaccaagaatggatacgctcaggtgatttaagcagtcttccatggccacgagctctgtggttgcctctgtatattaagagcacagagattaaaaatgggtgcacttgagccgattgaaacattcctccttgcatctttcttctgtgattgcatctatttgttagtagcatagagaccaataatagatggcttgtgctgatggaaggattcctccctggtgacatgctgtgtctgcctcttgattgggagcacgcagacctacaatgatgcactttttatgatttgagaattccttcatggtcacgtgctctgtttttatcatggttgggagcctgcagagcaataagggacatgcctttgctgatttgaggattcctctgaggttgggagctaagtttgcatcatgcttagaaaggagtgtgcagacctgtaatgattgcactttgctgattgaaggattccttcaagtccatgtgctccacttgcaccatttttaggatggagcctggagacctataatgaacaacttgtgctgtgttaaggattcctccatgatcacgcgccccatttgtacaccatgcttgggaaggtgcatgcagaccaatgttagtaatagtcaaaattcctgtgtcggtttgtgtggtttgctaaacaggactcaatgtatcatgaaacagtgtattatatagtcaactatggtcaactatgtcccagtgatatttatgagagggatctgaagtatttattgataatgcatatatgaaaaacggagaagaattaatgaaacagatatatctgtgttagaatgattctgtataaagatagggaatatcaagtctgttcttagtgttttgtgaatcacagagtgtaaaattattcccagtgaattaatgaataaatttaaagacaacatagaaatgaatgcagaaaaagagggtcaaccctggatcgatgatgagcactggtggagtatgagtcacatacgatgaatacgtgtctggaactctgaggtccatcgcagaagtcagtttcctctgtttcaactaactctgtagatagatgacaagaatagagaatgaattttttttgtttatgagtttttattttataattggttcaatgaaagaataaaacatatatgaataaataaataagttatgcattgtccaattataaaaa

SEQ ID NO: 12343 - DNA, 1237 bp, Homo sapiens
  ENST00000637332
gttgggagctaagtttgcatcatgcttagaaaggagtgtgcagacctgtaatgattgcactttgctgattgaaggattccttcaagtccatgtgctccacttgcaccatttttaggatggagcctggagacctataatgaacaacttgtgctgtgttaaggattcctccatgatcacgcgccccatttgtacaccatgcttgggaaggtgcatgcagaccaataatggacgtacttgtgatgatttaaagatgcctccaaggtcacgtgctctgtttgcaccatgcttaggaaggagcgtacagaccaaaaatggatgaattgtgcaccttgaaaagttcttccatggtcacctgaggcatctgcgtcatgattaggctccggatgactaataatggacgtacttgttctgatttgaggacttcttcatggtcacatgttctgtttgcaccatgcttaggaaggagcatgtgtaccaataatggaagcacagaagctggttttaatagttaagagctgtatggtccatctctgtgctagaagctggagaccaataacagtcactccctgcactgattctgccatgaccacttgctctatggttgttttaaggaacctacagacaaataatggattatcattggtgaagatcttagctgttccatagaaggaacacacttatcactacagtgattctgtaatgatgaagacctttatgggatgggtagaccagagctgattaaattattctcccattgatgaggaactttaccttatccctcagagtaaggagaatgtcatataatgtaagtaataaagttcttgagttgggttgttggttcatgatttctactgtcatttaaaaagataattaaattttaaaaggtcatactaggcctatgatgagaatgtgttgtggaccgaaattaatccaatttagcacaaatgaagtgtaagaaaaaatttagctttcccattcattttcaatagttaaatgtcacattgtatgtttgtctcattgattatttaaagactcttctcttgataaaggctgttactcatttatggagtcagtattctagttgttgagtaggatggtggttcaagtttgttcatttgatatctaaaagttgttcaaattaaatgtagaggggccatgtctggaccaatgatgtgaatggaatgcatctgaataaaaattatgatcaatcagtttttggaacaactgaggtccactg

SEQ ID NO: 12344 - DNA, 66 bp, Homo sapiens
  ENST00000614605
ttggcttggtcaagtcagtgttcaaactatctcctgctctttcaaggggatctggggctctagaag

SEQ ID NO: 12345 - DNA, 7571 bp, Homo sapiens
  ENST00000503335
actttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 12346 - DNA, 2365 bp, Homo sapiens
  ENST00000508365
aaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctgggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtcatgtgcttgatttctagtgtctgagagctaccttgggaaacaggctaaggctggtgcaatggactttattttctaccaataggagctacccacagacacgaggcctccccaaccctgtagttccatcttgacttgcaaaacctgagataacttgacttcacaataggaaattctgcct

SEQ ID NO: 12347 - DNA, 2238 bp, Homo sapiens
  ENST00000418761
aaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagcttctttggtttctaaaggagtaaactgagatgaactgtca

SEQ ID NO: 12348 - DNA, 7594 bp, Homo sapiens
  ENST00000274473
tgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggtggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttcccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagctaggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcacatcatgaaagtgtacatgcatatgcaagtgtgaattacgtggtatggatgtttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaataaaaaa

SEQ ID NO: 12349 - DNA, 542 bp, Homo sapiens
  ENST00000515002
cctttctcttggacagagctccaatgccacttttaaaaagataatgaagtgaatttttgagggctgatctttactccttgccatttggcagcccttcttcccaacagagggcaataccccactagccaaacatttcgtgttagaaaactccaagccttcctactggcaggcacttcccatgttggaatcgaggacgtctgattttggtagctcagagtttcccagatctaaagaggacttggcttattagttaaagaactttctaactgaggaggaatgattaccattcagctttaagtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacctggaaaacactcatagctgtcaccccatgtctggagagtgtgcctgca

SEQ ID NO: 12350 - DNA, 583 bp, Homo sapiens
  ENST00000506709
gtgctgagcgctgcgactgcagccacgcagatggctgccaccctaccacgggccattgccgctgcctccccggatggtcagtctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcat

SEQ ID NO: 12351 - DNA, 463 bp, Homo sapiens
  ENST00000510513
ttggtggtctgtgtttcagggcagattgttttgtaaaaaggtccttcagcatttagaatcataaaatcataggaacatttacttgagctggaagcagtgacatggaggcctcttttctcatttatagatgataaaactgcagcctgaaagcttaagtgaaagttcagaatatctaggtcaatttttttagatgccagatttcttgaatctcaacccatgcctttagcgttatcacttgacggaccataaggaagaactatgtaatgcccaattttgaatttaatgagtaaggtattagggtaatgctatcaggtattatcaggacaaatctttctgtcatggaaaataactttgcacagaacaatatcttctgagctggtgttatcatagttggaaatctgaacagcttaagccgaaccagtactgctctccctgctgattcctaccagatcggggccattgc

SEQ ID NO: 12352 - DNA, 686 bp, Homo sapiens
  ENST00000510828
acagcagcctttctctgggcatggataggccgacaacatctgacaatgaggaatgtttgctttttcttcctgctctgtttccaaattaatgttttatgaactgaaaatatgcaggcattagcacagaaggaggtttttacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcag

SEQ ID NO: 12353 - DNA, 449 bp, Homo sapiens
  ENST00000507158
aatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatgg

SEQ ID NO: 12354 - DNA, 565 bp, Homo sapiens
  ENST00000515622
acccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgtttagaccagacagagacagtggcaacaggaagaagagaaggaacctacatgatggactggcactggataatctggccaggatggactggtgagacagatgctcctgtttatctggattaattgaattgcta

SEQ ID NO: 12355 - DNA, 6163 bp, Homo sapiens
  ENST00000409699
cgctcccggtgcccgctgcccgccgcccggctcccggctgctcgcggccccctgctcctgcctggcgctctggccaggctcgggctccggaggacaggaccgcgcgactggccggccgatccctgggccggccgcgggagcagcctcctttgttctcctgtgcagggcccgggatggtgctctccctgacggggctcattgccttctccttcctgcaagccacccttgccctgaaccccgaggaccccaacgtgtgcagccactgggagagctatgctgtgactgtccaggaatcgtatgcacaccccttcgatcagatctattacacacgatgcacagacatcctcaactggttcaagtgcaccaggcaccggatcagttataagacggcgtatcggagaggcctccggaccatgtaccggcggaggtcccagtgctgccctggctactatgagagcggagacttctgcatacccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcacctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcactgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcctcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacgtgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctcccttttttcctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaactaatttaacaagaatgcctactgttgtgttgcaaatggaaaacgtgcttataatctacaccttaagtttaagggtagaactaacctacatcctgcttgggcactttgaacacctggaagaatgaaaattattctagtagatgtttgaaaataagtgaaaaacttgtatcaaatttttgatagacgagtctctttctttaaagtaataaatgtgagcaccatat
